US007485297B2

(12) United States Patent
Wood et al.

(10) Patent No.: US 7,485,297 B2
(45) Date of Patent: Feb. 3, 2009

(54) METHOD OF INHIBITION OF VASCULAR DEVELOPMENT USING AN ANTIBODY

(75) Inventors: Clive R. Wood, Cambridge, MA (US); Daniel T. Dransfield, Hanson, MA (US); Henk Pieters, Maastricht (NL); Rene Hoet, Maastricht (NL); Simon E. Hufton, Clitheroe (GB)

(73) Assignee: Dyax Corp., Cambridge, MA (US)

( * ) Notice: Subject to any disclaimer, the term of this patent is extended or adjusted under 35 U.S.C. 154(b) by 159 days.

(21) Appl. No.: 11/199,739

(22) Filed: Aug. 9, 2005

(65) Prior Publication Data

US 2006/0057138 A1 Mar. 16, 2006

Related U.S. Application Data

(63) Continuation-in-part of application No. 11/049,536, filed on Feb. 2, 2005, which is a continuation-in-part of application No. 10/916,840, filed on Aug. 12, 2004, now Pat. No. 7,348,001, which is a continuation-in-part of application No. PCT/US2004/026116, filed on Aug. 12, 2004.

(60) Provisional application No. 60/494,713, filed on Aug. 12, 2003.

(51) Int. Cl.
*A61K 39/395* (2006.01)
*C07K 16/28* (2006.01)
*C07K 16/00* (2006.01)
*C12P 21/08* (2006.01)
*G01N 33/53* (2006.01)

(52) U.S. Cl. .............. 424/130.1; 424/133.1; 424/141.1; 424/143.1; 435/7.1; 530/387.1; 530/388.15; 530/388.22

(58) Field of Classification Search ........................ None
See application file for complete search history.

(56) References Cited

U.S. PATENT DOCUMENTS

| 5,521,073 | A | 5/1996 | Davis et al. |
| 5,851,797 | A | 12/1998 | Valenzuela et al. |
| 5,955,291 | A | 9/1999 | Alitalo et al. |
| 6,090,382 | A * | 7/2000 | Salfeld et al. ............ 424/133.1 |
| 6,365,154 | B1 | 4/2002 | Holmes et al. |
| 6,376,653 | B1 | 4/2002 | Holmes et al. |
| 6,441,137 | B1 | 8/2002 | Davis et al. |
| 6,492,331 | B1 | 12/2002 | Godowski et al. |
| 6,551,822 | B1 | 4/2003 | Godowski et al. |
| 6,586,397 | B1 | 7/2003 | Godowski et al. |
| 6,627,415 | B1 | 9/2003 | Davis et al. |
| 7,193,064 | B2 * | 3/2007 | Mikayama et al. ..... 530/388.73 |
| 2002/0115173 | A1 | 8/2002 | Ben-Sasson |
| 2002/0160478 | A1 | 10/2002 | Ben-Sasson |
| 2003/0040463 | A1 | 2/2003 | Wiegand et al. |
| 2003/0087393 | A1 | 5/2003 | O'Reilly et al. |
| 2003/0113782 | A1 | 6/2003 | Karim et al. |
| 2003/0152945 | A1 | 8/2003 | Deak et al. |
| 2003/0162712 | A1 | 8/2003 | Cerretti et al. |
| 2003/0166858 | A1 | 9/2003 | Davis et al. |
| 2003/0180718 | A1 | 9/2003 | Pillutla et al. |
| 2003/0219772 | A1 | 11/2003 | Kuyl et al. |
| 2004/0067882 | A1 | 4/2004 | Alsobrook, II et al. |
| 2004/0116330 | A1 | 6/2004 | Naito et al. |
| 2004/0147449 | A1 | 7/2004 | Siemeister et al. |
| 2004/0248781 | A1 | 12/2004 | Kerbel |

FOREIGN PATENT DOCUMENTS

| EP | 753 015 B1 | 8/2000 |
| EP | 1 225 233 | 7/2002 |
| WO | WO 93/14124 | 7/1993 |
| WO | WO 94/10197 | 5/1994 |
| WO | WO 95/21866 | 8/1995 |
| WO | WO 95/26364 | 10/1995 |
| WO | WO 98/07835 | 2/1998 |
| WO | WO 01/11086 | 2/2001 |
| WO | WO 01/47944 | 7/2001 |
| WO | WO 01/72339 | 10/2001 |
| WO | WO 01/88088 | 11/2001 |
| WO | WO 02/079492 | 10/2002 |
| WO | WO 02/102973 | 12/2002 |
| WO | WO 03/004529 | 1/2003 |
| WO | WO 03/064628 | 8/2003 |
| WO | WO 2005/016966 | 2/2005 |

OTHER PUBLICATIONS

Hurwitz et al., Bevacizumab plus Irinotecan, fluorouracil and leucovorin fo metastatic colorectal cancer. N Eng. J Med. 350, 2335-2342, 2004.*
Juha Partanen et al., "A Novel Endothelial Cell Surface Receptor Tyrosine Kinase with Exrtacellular Epidermal Growth Factor Homology Domains" *Molecular and Cellular Biology*, vol. 12, No. 4:pp. 1698-1707 (1992).
Davis et al. "Isolation of angiopoietin-1, a ligand for the TIE2 receptor, by secretion-trap expression cloning" *Cell* 87:1161-1169 (1996).
International Search Report for PCT US2004/026116.
Chen-Konak et al., "Transcriptional and post-translation regulation of the Tie1 receptor by fluid shear stress changes in vascular endothelial cells," FASEB J.(2003) 17:2121-23.
Jones et al., "Tie receptors: new modulators of angiogenic and lymphangiogenic responses," Nat Rev. Mol. Cell Biol., (Apr. 2001) 2(4):257-67.
Kontos et al., "The endothelial receptor tyrosine kinase Tie1 activates phosphatidylinositol 3-kinase and Akt to inhibit apoptosis," Mol. Cell Biol. Mar. 2002;22(6):1704-13.
Lin et al., "tie-1 protein tyrosine kinase: a novel independent prognostic marker for gastric cancer," Clin. Cancer Res. (Jul. 1999) 5(7):1745-51.

(Continued)

*Primary Examiner*—Lorraine Spector
*Assistant Examiner*—Elly-Gerald Stoica
(74) *Attorney, Agent, or Firm*—Lahive & Cockfield, LLP; Giulio A. DeConti; Maria Laccotripe Zacharakis

(57) ABSTRACT

Tie1 and Tie2 are receptor tyrosine kinase proteins that include a transmembrane domain. Tie1 and Tie2 are present on endothelial cells. This disclosure describes agents, such as antibodies, that bind to Tie1, Tie2, and Ang, including ones that inhibit endothelial cell activity and angiogenesis. The agents can be used to treat angiogenesis-associated disorders.

30 Claims, 49 Drawing Sheets

OTHER PUBLICATIONS

Loughna and Sato, "A combinatorial role of angiopoietin-1 and orphan receptor TIE1 pathways in establishing vascular polarity during angiogenesis," Mol. Cell (2001) 7:233-39.

Marron et al., "Tie-1 receptor tyrosine kinase endodomain interaction with SHP2: potential signalling mechanisms and roles in angiogenesis," Adv. Exp. Med. Biol. (2000) 476:35-46.

Marron et al., "Evidence for heterotypic interaction between the receptor tyrosine kinases TIE-1 and TIE-2," J Biol Chem. (Dec. 2000) 15;275(50):39741-6.

Puri et al., "The receptor tyrosine kinase TIE is required for integrity and survival of vascular endothelial cells," EMBO J. (Dec. 1, 1995) 14(23):5884-91.

Shahrara et al., "Differential expression of the angiogenic Tie receptor family in arthritic and normal synovial tissue," Arthritis Res. (2002) 4:201-208.

Tsiamis et al., "Characterization and regulation of the receptor tyrosine kinase Tie-1 in platelets," J. Vasc. Res. (Nov.-Dec. 2000) 37:437-42.

Barrios et al., "Length of the antibody heavy chain complementarity determining region 3 as specificity-determining factor," *J. Molec. Recog.*, 17:332-338, 2004.

Kobrin et al., "A V region mutation in a phosphocholine-binding monoclonal antibody results in loss of antigen binding," *J. Immunol.*, 146:2017-2020, 1991.

Rudikoff et al., "Single amino acid substitution altering antigen-binding specificity," *Proc. Natl. Acad. Sci., USA*, 79:1979-1983, 1982.

International Search Report dated Nov. 2, 2007 from International Application No. PCT/US04/26116.

* cited by examiner

```
VH-PA1 (1-396)
Total amino acid number: 132, MW=14169

1     GAAGTTCAATTGTTAGAGTCTGGTGGCGGTCTTGTTCAGCCTGGTGGTTCTTTACGTCTT
1      E  V  Q  L  L  E  S  G  G  G  L  V  Q  P  G  G  S  L  R  L

61    TCTTGCGCTGCTTCCGGATTCACTTTCTCTATTTACAAGATGTCTTGGGTTCGCCAAGCT
21     S  C  A  A  S  G  F  T  F  S  I  Y  K  M  S  W  V  R  Q  A

121   CCTGGTAAAGGTTTGGAGTGGGTTTCTTCTATCTATCCTTCTGGTGGCCAGACTAAGTAT
41     P  G  K  G  L  E  W  V  S  S  I  Y  P  S  G  G  Q  T  K  Y

181   GCTGACTCCGTTAAAGGTCGCTTCACTATCTCTAGAGACAACTCTAAGAATACTCTCTAC
61     A  D  S  V  K  G  R  F  T  I  S  R  D  N  S  K  N  T  L  Y

241   TTGCAGATGAACAGCTTAAGGGCTGAGGACACTGCAGTCTACTATTGTGCGAGAGTCAAT
81     L  Q  M  N  S  L  R  A  E  D  T  A  V  Y  Y  C  A  R  V  N

301   TACTATGATAGTAGTGGTTACGGTCCTATAGCTCCTGGACTTGACTACTGGGGCCAGGGA
101    Y  Y  D  S  S  G  Y  G  P  I  A  P  G  L  D  Y  W  G  Q  G

361   ACCCTGGTCACCGTCTCAAGCGCCTCCACCAAGGGC    (SEQ ID NO:3)
121    T  L  V  T  V  S  S  A  S  T  K  G    (SEQ ID NO:4)
```

FIG. 7A

```
VL-PA1 (1-311)
Total amino acid number: 103, MW=11169

1     CAAGACATCCAGATGACCCAGTCTCCAGGCACCCTGTCTTTGTCTCCAGGGGAAAGAGCC
1      Q  D  I  Q  M  T  Q  S  P  G  T  L  S  L  S  P  G  E  R  A

61    ACCCTCTCCTGCAGGGCCAGTCAGAGTGTTAGCAGCAGCTACTTAGCCTGGTACCAGCAG
21     T  L  S  C  R  A  S  Q  S  V  S  S  S  Y  L  A  W  Y  Q  Q

121   AAACCTGGCCAGGCTCCCAGGCTCCTCATCTATGGTGCATCCAGCAGGGCCACTGGCATC
41     K  P  G  Q  A  P  R  L  L  I  Y  G  A  S  S  R  A  T  G  I

181   CCAGACAGGTTCAGTGGCAGTGGGTCTGGGACAGACTTCACTCTCACCATCAGCAGACTG
61     P  D  R  F  S  G  S  G  S  G  T  D  F  T  L  T  I  S  R  L

241   GAGCCTGAAGATTTTGCAGTGTATTACTGTCAGCAGTATGGTAGCTCCCGGTGGACGTTC
81     E  P  E  D  F  A  V  Y  Y  C  Q  Q  Y  G  S  S  R  W  T  F

301   GGCCAAGGGAC    (SEQ ID NO:5)
101    G  Q  G      (SEQ ID NO:6)
```

FIG. 7B

VH-PA5 (1-396)
Total amino acid number: 132, MW=14309

```
1    GAAGTTCAATTGTTAGAGTCTGGTGGCGGTCTTGTTCAGCCTGGTGGTTCTTTACGTCTT
1     E  V  Q  L  L  E  S  G  G  G  L  V  Q  P  G  G  S  L  R  L

61   TCTTGCGCTGCTTCCGGATTCACTTTCTCTTATTACCTTATGTATTGGGTTCGCCAAGCT
21    S  C  A  A  S  G  F  T  F  S  Y  Y  L  M  Y  W  V  R  Q  A

121  CCTGGTAAAGGTTTGGAGTGGGTTTCTTCTATCTATCCTTCTGGTGGCTGGACTGTTTAT
41    P  G  K  G  L  E  W  V  S  S  I  Y  P  S  G  G  W  T  V  Y

181  GCTGACTCCGTTAAAGGTCGCTTCACTATCTCTAGAGACAACTCTAAGAATACTCTCTAC
61    A  D  S  V  K  G  R  F  T  I  S  R  D  N  S  K  N  T  L  Y

241  TTGCAGATGAACAGCTTAAGGGCTGAGGACACTGCAGTCTACTATTGTGCGAGAGTCAAT
81    L  Q  M  N  S  L  R  A  E  D  T  A  V  Y  Y  C  A  R  V  N

301  TACTATGATAGTAGTGGTTACGGTCCTATAGCTCCTGGACTTGACTACTGGGGCCAGGGA
101   Y  Y  D  S  S  G  Y  G  P  I  A  P  G  L  D  Y  W  G  Q  G

361  ACCCTGGTCACCGTCTCAAGCGCCTCCACCAAGGGC   (SEQ ID NO:7)
121   T  L  V  T  V  S  S  A  S  T  K  G    (SEQ ID NO:8)
```

FIG. 8A

VL-PA5 (1-308)
Total amino acid number: 101, MW=10801

```
1    CAAGACATCCAGATGACCCAGTCTCCATCCTCCCTGTCTGCATCTGTCGGAGACAGAGTC
1     Q  D  I  Q  M  T  Q  S  P  S  S  L  S  A  S  V  G  D  R  V

61   ACCATCACTTGCCGGGCAAGTTAGAGCATTAGCACCTCTTTAAATTGGTATCAGCAAAAA
21    T  I  T  C  R  A  S  *  S  I  S  T  S  L  N  W  Y  Q  Q  K

121  TCAGGGAAAGCCCCTAAGCTCCTGATATATGCTGCATCCAGTTTGCAAAGTGAAGTCCCA
41    S  G  K  A  P  K  L  L  I  Y  A  A  S  S  L  Q  S  E  V  P

181  TCAAGGTTCAGTGGCAGTGGATCTGGGACAGATTTCACTCTCACCATCACCAGTCTGCAA
61    S  R  F  S  G  S  G  S  G  T  D  F  T  L  T  I  T  S  L  Q

241  CCTGAAGATTTTGCAACTTACTACTGTCAACAGAGTTACAGTACCCCTCCGACTTTCGGC
81    P  E  D  F  A  T  Y  Y  C  Q  Q  S  Y  S  T  P  P  T  F  G

301  CAAGGGAC   (SEQ ID NO:9)
101   Q  G    (SEQ ID NO:10)
```

FIG. 8B

```
VH-PA6 (1-439)
Total amino acid number: 146, MW=15647

1       GAAGTTCAATTGTTAGAGTCTGGTGGCGGTCTTGTTCAGCCTGGTGGTTCTTTACGTCTT
1         E  V  Q  L  L  E  S  G  G  G  L  V  Q  P  G  G  S  L  R  L

61      TCTTGCGCTGCTTCCGGATTCACTTTCTCTATGTACGTTATGAAGTGGGTTCGCCAAGCT
21        S  C  A  A  S  G  F  T  F  S  M  Y  V  M  K  W  V  R  Q  A

121     CCTGGTAAAGGTTTGGAGTGGGTTTCTTCTATCTATCCTTCTGGTGGCTATACTCGTTAT
41        P  G  K  G  L  E  W  V  S  S  I  Y  P  S  G  G  Y  T  R  Y

181     GCTGACTCCGTTAAAGGTCGCTTCACTATCTCTAGAGACAACTCTAAGAATACTCTCTAC
61        A  D  S  V  K  G  R  F  T  I  S  R  D  N  S  K  N  T  L  Y

241     TTGCAGATGAACAGCTTAAGGGCTGAGGACACTGCAGTCTACTATTGTGCGAGAGTCAAT
81        L  Q  M  N  S  L  R  A  E  D  T  A  V  Y  Y  C  A  R  V  N

301     TACTATGATAGTAGTGGTTACGGTCCTATAGCTCCTGGACTTGACTACTGGGGCCAGGGA
101       Y  Y  D  S  S  G  Y  G  P  I  A  P  G  L  D  Y  W  G  Q  G

361     ACCCTGGTCACCGTCTCAAGCGCCTCCACCAAGGGCCCATCGGTCTTCCCGCTAGCACCC
121       T  L  V  T  V  S  S  A  S  T  K  G  P  S  V  F  P  L  A  P

421     TCCTCCAAGAGCACCTCTG       (SEQ ID NO:11)
141       S  S  K  S  T  S      (SEQ ID NO:12)
```

FIG. 9A

```
VL-PA6 (1-311)
Total amino acid number: 103, MW=11056

1       CAAGACATCCAGATGACCCAGTCTCCAGGCACCCTGTCTTTGTCTCCAGGGGAAAGAGCC
1         Q  D  I  Q  M  T  Q  S  P  G  T  L  S  L  S  P  G  E  R  A

61      ACCCTCTCCTGCAGGGCCAGTCAGAGTGTTAGCAGCAGCTACTTAGCCTGGTACCAGCAG
21        T  L  S  C  R  A  S  Q  S  V  S  S  S  Y  L  A  W  Y  Q  Q

121     AAACCTGGCCAGGCTCCCAGGCTCCTCATCTATGGTGCATCCAGCAGGGCCACTGGCATC
41        K  P  G  Q  A  P  R  L  L  I  Y  G  A  S  S  R  A  T  G  I

181     CCAGACAGGTTCAGTGGCAGTGGGTCTGGGACAGACTTCACTCTCACCATCAGCAGACTG
61        P  D  R  F  S  G  S  G  S  G  T  D  F  T  L  T  I  S  R  L

241     GAGCCTGAAGATTTTGCAGTGTATTACTGTCAGCAGTATGGTAGCTCCCTATTCACTTTC
81        E  P  E  D  F  A  V  Y  Y  C  Q  Q  Y  G  S  S  L  F  T  F

301     GGCCCTGGGAC       (SEQ ID NO:13)
101       G  P  G      (SEQ ID NO:14)
```

FIG. 9B

VH-PA10 (1-439)
Total amino acid number: 146, MW=15499

| | |
|---|---|
| 1 | GAAGTTCAATTGTTAGAGTCTGGTGGCGGTCTTGTTCAGCCTGGTGGTTCTTTACGTCTT |
| 1 | E  V  Q  L  L  E  S  G  G  G  L  V  Q  P  G  G  S  L  R  L |
| 61 | TCTTGCGCTGCTTCCGGATTCACTTTCTCTTCTTACAAGATGGGTTGGGTTCGCCAAGCT |
| 21 | S  C  A  A  S  G  F  T  F  S  S  Y  K  M  G  W  V  R  Q  A |
| 121 | CCTGGTAAAGGTTTGGAGTGGGTTTCTTGGATCTATCCTTCTGGTGGCGGTACTACTTAT |
| 41 | P  G  K  G  L  E  W  V  S  W  I  Y  P  S  G  G  T  T  Y |
| 181 | GCTGACTCCGTTAAAGGTCGCTTCACTATCTCTAGAGACAACTCTAAGAATACTCTCTAC |
| 61 | A  D  S  V  K  G  R  F  T  I  S  R  D  N  S  K  N  T  L  Y |
| 241 | TTGCAGATGAACAGCTTAAGGGCTGAGGACACTGCAGTCTACTATTGTGCGAGAGTCAAT |
| 81 | L  Q  M  N  S  L  R  A  E  D  T  A  V  Y  Y  C  A  R  V  N |
| 301 | TACTATGATAGTAGTGGTTACGGTCCTATAGCTCCTGGACTTGACTACTGGGGCCAGGGA |
| 101 | Y  Y  D  S  S  G  Y  G  P  I  A  P  G  L  D  Y  W  G  Q  G |
| 361 | ACCCTGGTCACCGTCTCAAGCGCCTCCACCAAGGGCCCATCGGTCTTCCCGCTAGCACCC |
| 121 | T  L  V  T  V  S  S  A  S  T  K  G  P  S  V  F  P  L  A  P |
| 421 | TCCTCCAAGAGCACCTCTG   (SEQ ID NO:15) |
| 141 | S  S  K  S  T  S    (SEQ ID NO:16) |

FIG. 10A

VL-PA10 (1-311)
Total amino acid number: 103, MW=11110

| | |
|---|---|
| 1 | CAAGACATCCAGATGACCCAGTCTCCAGGCACCCTGTCTTTGTCTCCAGGGGAAAGAGCC |
| 1 | Q  D  I  Q  M  T  Q  S  P  G  T  L  S  L  S  P  G  E  R  A |
| 61 | ACCCTCTCCTGCAGGGCCAGTCAGAGTGTTAGCAGCAGCTACTTAGCCTGGTACCAGCAG |
| 21 | T  L  S  C  R  A  S  Q  S  V  S  S  S  Y  L  A  W  Y  Q  Q |
| 121 | AAACCTGGCCAGGCTCCCAGGCTCCTCATCTATGGTGCATCCAGCAGGGCCACTGGCATC |
| 41 | K  P  G  Q  A  P  R  L  L  I  Y  G  A  S  S  R  A  T  G  I |
| 181 | CCAGACAGGTTCAGTGGCAGTGGGTCTGGGACAGACTTCACTCTCACCATCAGCAGACTG |
| 61 | P  D  R  F  S  G  S  G  S  G  T  D  F  T  L  T  I  S  R  L |
| 241 | GAGCCTGAAGATTTTGCAGTGTATTACTGTCAGCAGTATGGTAGCTCACCGTGGACGTTC |
| 81 | E  P  E  D  F  A  V  Y  Y  C  Q  Q  Y  G  S  S  P  W  T  F |
| 301 | GGCCAAGGGAC    (SEQ ID NO:17) |
| 101 | G  Q  G    (SEQ ID NO:18) |

FIG. 10B

VH-PB1 (1-446)
Total amino acid number: 148, MW=15809

```
1      GAAGTTCAATTGTTAGAGTCTGGTGGCGGTCTTGTTCAGCCTGGTGGTTCTTTACGTCTT
1        E  V  Q  L  L  E  S  G  G  G  L  V  Q  P  G  G  S  L  R  L

61     TCTTGCGCTGCTTCCGGATTCACTTTCTCTCGTTACCCTATGGTTTGGGTTCGCCAAGCT
21       S  C  A  A  S  G  F  T  F  S  R  Y  P  M  V  W  V  R  Q  A

121    CCTGGTAAAGGTTTGGAGTGGGTTTCTGTTATCTCTCCTTCTGGTGGCCAGACTTTTTAT
41       P  G  K  G  L  E  W  V  S  V  I  S  P  S  G  G  Q  T  F  Y

181    GCTGACTCCGTTAAAGGTCGCTTCACTATCTCTAGAGACAACTCTAAGAATACTCTCTAC
61       A  D  S  V  K  G  R  F  T  I  S  R  D  N  S  K  N  T  L  Y

241    TTGCAGATGAACAGCTTAAGGGCTGAGGACACTGCAGTCTACTATTGTGCGAGAGGGGTC
81       L  Q  M  N  S  L  R  A  E  D  T  A  V  Y  Y  C  A  R  G  V

301    CTCACCACCGCTTTTGATATCTGGGGCCAAGGGACAATGGTCACCGTCTCAAGCGCCTCC
101      L  T  T  A  F  D  I  W  G  Q  G  T  M  V  T  V  S  S  A  S

361    ACCAAGGGCCCATCGGTCTTCCCGCTAGCACCCTCCTCCAAAGCACCTCTGGGGGCACAG
121      T  K  G  P  S  V  F  P  L  A  P  S  S  K  A  P  L  G  A  Q

421    CGGCCCTGGGCTGCCTGGTCAAGGAC    (SEQ ID NO:19)
141      R  P  W  A  A  W  S  R    (SEQ ID NO:20)
```

FIG. 11A

VL-PB1 (1-308)
Total amino acid number: 102, MW=11057

```
1      CAAGACATCCAGATGACCCAGTCTCCATCCTCCCTGTCTGCATCTGTGGGAGACAGAGTC
1        Q  D  I  Q  M  T  Q  S  P  S  S  L  S  A  S  V  G  D  R  V

61     ACCATCACTTGCCGGGCAAGTCAGAACATTAACAGCTATTTAAATTGGTATCAGCAGAAA
21       T  I  T  C  R  A  S  Q  N  I  N  S  Y  L  N  W  Y  Q  Q  K

121    CCAGGGCAAGCCCCTAAACTCCTGATCTATGCTGCCTCCAATTTGGAAACTGCGGTCCCA
41       P  G  Q  A  P  K  L  L  I  Y  A  A  S  N  L  E  T  A  V  P

181    TCAAGGTTCAGCGGCAGTGGATCTGGGACAGATTTCACTCTCACCATCAGTAGCCTGCAG
61       S  R  F  S  G  S  G  S  G  T  D  F  T  L  T  I  S  S  L  Q

241    CCTGAAGATTTTGCAACTTATTATTGTCAACAATTTAATACTTACCCTCTCACTTTCGGC
81       P  E  D  F  A  T  Y  Y  C  Q  Q  F  N  T  Y  P  L  T  F  G

301    GGAGGGAC    (SEQ ID NO:21)
101      G  G     (SEQ ID NO:22)
```

FIG. 11B

VH-PB3 (1-393)
Total amino acid number: 131, MW=13931

```
1     GAAGTTCAATTGTTAGAGTCTGGTGGCGGTCTTGTTCAGCCTGGTGGTTCTTTACGTCTT
1       E  V  Q  L  L  E  S  G  G  G  L  V  Q  P  G  G  S  L  R  L

61    TCTTGCGCTGCTTCCGGATTCACTTTCTCTCGTTACGGTATGCATTGGGTTCGCCAAGCT
21      S  C  A  A  S  G  F  T  F  S  R  Y  G  M  H  W  V  R  Q  A

121   CCTGGTAAAGGTTTGGAGTGGGTTTCTGTTATCTCTCCTTCTGGTGGCATGACTTATTAT
41      P  G  K  G  L  E  W  V  S  V  I  S  P  S  G  G  M  T  Y  Y

181   GCTGACTCCGTTAAAGGTCGCTTCACTATCTCTAGAGACAACACTAAGAATACTCTCTAC
61      A  D  S  V  K  G  R  F  T  I  S  R  D  N  T  K  N  T  L  Y

241   TTGCAGATGAACAGCTTAAGGGCTGAGGACACTGCAGTCTACTATTGTGCGAGAGTGGGA
81      L  Q  M  N  S  L  R  A  E  D  T  A  V  Y  Y  C  A  R  V  G

301   GCTACCGGGCCTTTTGATATCTGGGGCCAAGGGACAATGGTCACCGTCTCAAGCGCCTCC
101     A  T  G  P  F  D  I  W  G  Q  G  T  M  V  T  V  S  S  A  S

361   ACCAAGGGCCCATCGGTCTTCCCGCTAGCACCC    (SEQ ID NO:23)
121     T  K  G  P  S  V  F  P  L  A  P  (SEQ ID NO:24)
```

FIG. 12A

VL-PB3 (1-308)
Total amino acid number: 102, MW=11032

```
1     CAAGACATCCAGATGACCCAGTCTCCAGCCACCCTGTCTTTGTCTCCAGGGGAAAGAGCC
1       Q  D  I  Q  M  T  Q  S  P  A  T  L  S  L  S  P  G  E  R  A

61    ACCCTCTCCTGCAGGGCCAGTCAGAGTGTTAGCACCTACTTAGCCTGGTACCAACAGAAA
21      T  L  S  C  R  A  S  Q  S  V  S  T  Y  L  A  W  Y  Q  Q  K

121   CCTGGCCAGGCTCCCAGGCTTCTCATCTATGATGCATCCAACAGGGCCACTGGCATCCCA
41      P  G  Q  A  P  R  L  L  I  Y  D  A  S  N  R  A  T  G  I  P

181   GGCAGGTTCAGTGGCAGTGGGTCTGGGACAGACTTCACTCTCACCATCAGCAGCCTAGAG
61      G  R  F  S  G  S  G  S  G  T  D  F  T  L  T  I  S  S  L  E

241   GCTGAAGACTTTGCAGTTTATTACTGTCAGCAGCGTAGCAGCTGGCCGATCACCTTCGGC
81      A  E  D  F  A  V  Y  Y  C  Q  Q  R  S  S  W  P  I  T  F  G

301   CAAGGGAC  (SEQ ID NO:25)
101     Q  G  (SEQ ID NO:26)
```

FIG. 12B

VH-PC6 (1-429)
Total amino acid number: 143, MW=14727

| | |
|---|---|
| 1 | GAAGTTCAATTGTTAGAGTCTGGTGGCGGTCTTGTTCAGCCTGGTGGTTCTTTACGTCTT |
| 1 | E  V  Q  L  L  E  S  G  G  G  L  V  Q  P  G  G  S  L  R  L |
| 61 | TCTTGCGCTGCTTCCGGATTCACTTTCTCTCATTACGGTATGACTTGGGTTCGCCAAGCT |
| 21 | S  C  A  A  S  G  F  T  F  S  H  Y  G  M  T  W  V  R  Q  A |
| 121 | CCTGGTAAAGGTTTGGAGTGGGTTTCTGTTATCTCTCCTTCTGGTGGCCAGACTGGTTAT |
| 41 | P  G  K  G  L  E  W  V  S  V  I  S  P  S  G  G  Q  T  G  Y |
| 181 | GCTGACTCCGTTAAAGGTCGCTTCACTATCTCTAGAGACAACTCTAAGAATACTCTCTAC |
| 61 | A  D  S  V  K  G  R  F  T  I  S  R  D  N  S  K  N  T  L  Y |
| 241 | TTGCAGATGAACAGCTTAAGGGCTGAGGACACTGCAGTCTACTATTGTGCGGGTGGTGGC |
| 81 | L  Q  M  N  S  L  R  A  E  D  T  A  V  Y  Y  C  A  G  G  G |
| 301 | TACGCAGCCTTTGACTACTGGGGCCAGGGAACCCTGGTCACCGTCTCAAGCGCCTCCACC |
| 101 | Y  A  A  F  D  Y  W  G  Q  G  T  L  V  T  V  S  S  A  S  T |
| 361 | AAGGGCCCATCGGTCTTCCCGCTAGCACCCTCCTCCAAGAGCACCTCTGGGGGCACAGCG |
| 121 | K  G  P  S  V  F  P  L  A  P  S  S  K  S  T  S  G  G  T  A |
| 421 | GCCCTGGGC (SEQ ID NO:27) |
| 141 | A  L  G   (SEQ ID NO:28) |

FIG. 13A

VL-PC6 (1-308)
Total amino acid number: 102, MW=11014

| | |
|---|---|
| 1 | CAAGACATCCAGATGACCCAGTCTCCAGCCACCCTGTCTTTGTCTCCAGGGGAAAGAGCC |
| 1 | Q  D  I  Q  M  T  Q  S  P  A  T  L  S  L  S  P  G  E  R  A |
| 61 | ACCCTCTCCTGCAGGGCCAGTCAGAGTGTTAGCAGCTACTTAGCCTGGTACCAACAGAAA |
| 21 | T  L  S  C  R  A  S  Q  S  V  S  S  Y  L  A  W  Y  Q  Q  K |
| 121 | CCTGGCCAGGCTCCCAGGCTCCTCATCTATGATGCATCCAACAGGGCCACTGGCATCCCA |
| 41 | P  G  Q  A  P  R  L  L  I  Y  D  A  S  N  R  A  T  G  I  P |
| 181 | GCCAGGTTCAGTGGCAGTGGGTCTGGGACAGACTTCACTCTCACCATCAGCAGCCTAGAG |
| 61 | A  R  F  S  G  S  G  S  G  T  D  F  T  L  T  I  S  S  L  E |
| 241 | CCTGAAGATTTTGCAGTTTATTACTGTCAGCAGCGTAGCAACTGGCCTCTCACTTTCGGC |
| 81 | P  E  D  F  A  V  Y  Y  C  Q  Q  R  S  N  W  P  L  T  F  G |
| 301 | GGAGGGAC (SEQ ID NO:29) |
| 101 | G  G   (SEQ ID NO:30) |

FIG. 13B

VH-PD6 (1-396)
Total amino acid number: 132, MW=14217

```
1      GAAGTTCAATTGTTAGAGTCTGGTGGCGGTCTTGTTCAGCCTGGTGGTTCTTTACGTCTT
1       E  V  Q  L  L  E  S  G  G  G  L  V  Q  P  G  G  S  L  R  L

61     TCTTGCGCTGCTTCCGGATTCACTTTCTCTGCTTACCGTATGGAGTGGGTTCGCCAAGCT
21      S  C  A  A  S  G  F  T  F  S  A  Y  R  M  E  W  V  R  Q  A

121    CCTGGTAAAGGTTTGGAGTGGGTTTCTTCTATCTATCCTTCTGGTGGCATTACTTATTAT
41      P  G  K  G  L  E  W  V  S  S  I  Y  P  S  G  G  I  T  Y  Y

181    GCTGACTCCGTTAAAGGTCGCTTCACTATCTCTAGAGACAACTCTAAGAATACTCTCTAC
61      A  D  S  V  K  G  R  F  T  I  S  R  D  N  S  K  N  T  L  Y

241    TTGCAGATGAACAGCTTAAGGGCTGAGGACACTGCAGTCTACTATTGTGCGAGAGTCAAT
81      L  Q  M  N  S  L  R  A  E  D  T  A  V  Y  Y  C  A  R  V  N

301    TACTATGATAGTAGTGGTTACGGTCCTATAGCTCCTGGACTTGACTACTGGGGCCAGGGA
101     Y  Y  D  S  S  G  Y  G  P  I  A  P  G  L  D  Y  W  G  Q  G

361    ACCCTGGTCACCGTCTCAAGCGCCTCCACCAAGGGC     (SEQ ID NO:31)
121     T  L  V  T  V  S  S  A  S  T  K  G     (SEQ ID NO:32)
```

FIG. 14A

VL-PD6 (1-308)
Total amino acid number: 101, MW=10731

```
1      CAAGACATCCAGATGACCCAGTCTCCATCCTCCCTGTCTGCATCTGTAGGAGACAGAGTT
1       Q  D  I  Q  M  T  Q  S  P  S  S  L  S  A  S  V  G  D  R  V

61     ACCATCACTTGCCGGGCAAGTCAGGGCATTACCACTTATTTAGGCTGGTATTAGCAGAAA
21      T  I  T  C  R  A  S  Q  G  I  T  T  Y  L  G  W  Y  *  Q  K

121    CCAGGGAAAGCCCCTAAGCTCCTGATCTATGCTGCATCCACTTTGCAAAGTGGGGTCCCA
41      P  G  K  A  P  K  L  L  I  Y  A  A  S  T  L  Q  S  G  V  P

181    GCAAAGTTCAGCGGCAGTGGATCTGGGACACTTTTCACTCTCACCATCAGCGGTCTGCAA
61      A  K  F  S  G  S  G  S  G  T  L  F  T  L  T  I  S  G  L  Q

241    CCTGAAGATTCTGCAACTTACTACTGTCACCAGAGTTACAATACCCCTTGGACGTTCGGC
81      P  E  D  S  A  T  Y  Y  C  H  Q  S  Y  N  T  P  W  T  F  G

301    CAAGGGAC     (SEQ ID NO:33)
101     Q  G     (SEQ ID NO:34)
```

FIG. 14B

VH-PD10 (1-412)
Total amino acid number: 136, MW=14313

```
1    GAAGTTCAATTGTTAGAGTCTGGTGGCGGTCTTGTTCAGCCTGGTGGTTCTTTACGTCTT
1     E  V  Q  L  L  E  S  G  G  G  L  V  Q  P  G  G  S  L  R  L

61   TCTTGCGCTGCTTCCGGATTCACTTTCTCTGGTTACGGTATGCATTGGGTTCGCCAAGCT
21    S  C  A  A  S  G  F  T  F  S  G  Y  G  M  H  W  V  R  Q  A

121  CCTGGTAAAGGTTTGGAGTGGGTTTCTGTTATCTCTCCTTCTGGTGGCCAGACTTGGTAG
41    P  G  K  G  L  E  W  V  S  V  I  S  P  S  G  G  Q  T  W  *

181  GCTGACTCCGTTAAAGGTCGCTTCACTATCTCTAGAGACAACTCTAAGAATACTCTCTAC
61    A  D  S  V  K  G  R  F  T  I  S  R  D  N  S  K  N  T  L  Y

241  TTGCAGATGAACAGCTTAAGGGCTGAGGACACTGCAGTCTACTATTGTGCGAGAGGCGGG
81    L  Q  M  N  S  L  R  A  E  D  T  A  V  Y  Y  C  A  R  G  G

301  ACCAGTAACCCACTGTTTTACTGGGGCCAGGGAACCCTGGTCACCGTCTCAAGCGCCTCC
101   T  S  N  P  L  F  Y  W  G  Q  G  T  L  V  T  V  S  S  A  S

361  ACCAAGGGCCCATCGGTCTTCCCGCTAGCACCCTCCTCCAAGAGCACCTCTG  (SEQ ID
NO:35)121     T  K  G  P  S  V  F  P  L  A  P  S  S  K  S  T  S
(SEQ ID NO:36)
```

FIG. 15A

VL-PD10 (1-308)
Total amino acid number: 102, MW=11069

```
1    CAAGACATCCAGATGACCCAGTCTCCAGCCACCCTGTCTTTGTCTCCAGGGGAAAGAGCC
1     Q  D  I  Q  M  T  Q  S  P  A  T  L  S  L  S  P  G  E  R  A

61   ACCCTCTCCTGCAGGGCCAGTCAGAGTGTTAGCAGCTACTTAGCCTGGTACCAACAGAAA
21    T  L  S  C  R  A  S  Q  S  V  S  S  Y  L  A  W  Y  Q  Q  K

121  CCTGGCCAGGCTCCCAGGCTCCTCATCTATGATGCATCCAACAGGGCCACTGGCATCCCA
41    P  G  Q  A  P  R  L  L  I  Y  D  A  S  N  R  A  T  G  I  P

181  GCCAGGTTCAGTGGCAGTGGGTCTGGGACAGACTTCACTCTCACCATCAGCAGCCTAGAG
61    A  R  F  S  G  S  G  S  G  T  D  F  T  L  T  I  S  S  L  E

241  CCTGAAGATTTTGCAGTTTATTACTGTCAGCAGCGTAGCAACTGGCCTCCGACTTTTGGC
81    P  E  D  F  A  V  Y  Y  C  Q  Q  R  S  N  W  P  P  T  F  G

301  CAGGGGAC  (SEQ ID NO:37)
101   Q  G  (SEQ ID NO:38)
```

FIG. 15B

VH-PD12 (1-444)
Total amino acid number: 148, MW=15535

```
1     GAAGTTCAATTGTTAGAGTCTGGTGGCGGTCTTGTTCAGCCTGGTGGTTCTTTACGTCTT
1      E  V  Q  L  L  E  S  G  G  G  L  V  Q  P  G  G  S  L  R  L

61    TCTTGCGCTGCTTCCGGATTCACTTTCTCTGGTTACGGTATGCATTGGGTTCGCCAAGCT
21     S  C  A  A  S  G  F  T  F  S  G  Y  G  M  H  W  V  R  Q  A

121   CCTGGTAAAGGTTTGGAGTGGGTTTCTGTTATCTCTCCTTCTGGTGGCCAGACTTCTTAT
41     P  G  K  G  L  E  W  V  S  V  I  S  P  S  G  G  Q  T  S  Y

181   GCTGACTCCGTTAAAGGTCGCTTCACTATCTCTAGAGACAACTCTAAGAATACTCTCTAC
61     A  D  S  V  K  G  R  F  T  I  S  R  D  N  S  K  N  T  L  Y

241   TTGCAGATGAACAGCTTAAGGGCTGAGGACACTGCAGTCTACTATTGTGCGAGAGATAGG
81     L  Q  M  N  S  L  R  A  E  D  T  A  V  Y  Y  C  A  R  D  R

301   CAGTATTACTATGGTTCGGGGAGTCTTGACTACTGGGGCCAGGGAACCCTGGTCACCGTC
101    Q  Y  Y  Y  G  S  G  S  L  D  Y  W  G  Q  G  T  L  V  T  V

361   TCAAGCGCCTCCACCAAGGGCCCATCGGTCTTCCCGCTAGCACCCTCCTCCAAGAGCACC
121    S  S  A  S  T  K  G  P  S  V  F  P  L  A  P  S  S  K  S  T

421   TCTGGGGGCACAGCGGCCCTGGGC    (SEQ ID NO:39)
141    S  G  G  T  A  A  L  G    (SEQ ID NO:40)
```

FIG. 16A

VL-PD12 (1-308)
Total amino acid number: 102, MW=11060

```
1     CAAGACATCCAGATGACCCAGTCTCCATCCTCCCTGTCTGCATCTGTAGGAGACAGAGTC
1      Q  D  I  Q  M  T  Q  S  P  S  S  L  S  A  S  V  G  D  R  V

61    ACCGTCACTTGCCGGGCAAGTCAGAGCATTAGCAGTTATTTAAATTGGTATCAGCAGAAA
21     T  V  T  C  R  A  S  Q  S  I  S  S  Y  L  N  W  Y  Q  Q  K

121   CCAGGGAAAGCCCCTAAACTCCTGATCTATGCTGCATCCAGTTTGCAAAGTGGGGTCCCA
41     P  G  K  A  P  K  L  L  I  Y  A  A  S  S  L  Q  S  G  V  P

181   TCAAGGTTCAGTGGCGGTGGATCTGGGACAGATTTCACTCTCACCATCAGCAGTCTGCAA
61     S  R  F  S  G  G  G  S  G  T  D  F  T  L  T  I  S  S  L  Q

241   CCTGAAGATTTTGCAACTTATTTCTGTCTACAAGATTACAAATACCCGTGGACGTTCGGC
81     P  E  D  F  A  T  Y  F  C  L  Q  D  Y  K  Y  P  W  T  F  G

301   CAAGGGAC      (SEQ ID NO:41)
101    Q  G       (SEQ ID NO:42)
```

FIG. 16B

VH-PF3 (1-375)
Total amino acid number: 125, MW=13201

```
1       GAAGTTCAATTGTTAGAGTCTGGTGGCGGTCTTGTTCAGCCTGGTGGTTCTTTACGTCTT
1        E  V  Q  L  L  E  S  G  G  G  L  V  Q  P  G  G  S  L  R  L

61      TCTTGCGCTGCTTCCGGATTCACTTTCTCTATGTACGGTATGGGTTGGGTTCGCCAAGCT
21       S  C  A  A  S  G  F  T  F  S  M  Y  G  M  G  W  V  R  Q  A

121     CCTGGTAAAGGTTTGGAGTGGGTTTCTGTTATCTCTCCTTCTGGTGGCCAGACTGCTTAT
41       P  G  K  G  L  E  W  V  S  V  I  S  P  S  G  G  Q  T  A  Y

181     GCTGACTCCGTTAAAGGTCGCTTCACTATCTCTAGAGACAACTCTAAGAATACTCTCTAC
61       A  D  S  V  K  G  R  F  T  I  S  R  D  N  S  K  N  T  L  Y

241     TTGCAGATGAACAGCTTAAGGGCTGAGGACACTGCAGTCTACTATTGTGCGAGAGTGGCC
81       L  Q  M  N  S  L  R  A  E  D  T  A  V  Y  Y  C  A  R  V  A

301     TTGCTCCTGGGCCACGCTTTTGATATCTGGGGCCAAGGGACAATGGTCACCGTCTCAAGC
101      L  L  L  G  H  A  F  D  I  W  G  Q  G  T  M  V  T  V  S  S

361     GCCTCCACCAAGGGC    (SEQ ID NO:43)
121      A  S  T  K  G    (SEQ ID NO:44)
```

FIG. 17A

VL-PF3 (1-308)
Total amino acid number: 102, MW=11162

```
1       CAAGACATCCAGATGACCCAGTCTCCTTCCACCCTGTCTGCATCTTTAGGAGACAGAGTC
1        Q  D  I  Q  M  T  Q  S  P  S  T  L  S  A  S  L  G  D  R  V

61      ACCATCACTTGCCGGGCCAGTGAGAGTATTAGTAGGTGGTTGGCCTGGTATCAGCAGAAA
21       T  I  T  C  R  A  S  E  S  I  S  R  W  L  A  W  Y  Q  Q  K

121     CCAGGGAAAGCCCCTAAGCTCCTGATGTATGAGGCATCCACTTTAGAAAGTGGGGTCCCA
41       P  G  K  A  P  K  L  L  M  Y  E  A  S  T  L  E  S  G  V  P

181     TCAAGGTTCACCGGCACTGGATCTGGGACAGAATTCACTCTCACCATCAGCAGCCTGCAG
61       S  R  F  T  G  T  G  S  G  T  E  F  T  L  T  I  S  S  L  Q

241     CCCGATGATTTTGCAACTTATTACTGTCAGCAGCGTAGCAACTGGCCCCTCACTTTCGGC
81       P  D  D  F  A  T  Y  Y  C  Q  Q  R  S  N  W  P  L  T  F  G

301     GGAGGGAC    (SEQ ID NO:45)
101      G  G       (SEQ ID NO:46)
```

FIG. 17B

VH-PF4 (1-429)
Total amino acid number: 143, MW=14996

```
1    GAAGTTCAATTGTTAGAGTCTGGTGGCGGTCTTGTTCAGCCTGGTGGTTCTTTACGTCTT
1     E  V  Q  L  L  E  S  G  G  G  L  V  Q  P  G  G  S  L  R  L

61   TCTTGCGCTGCTTCCGGATTCACTTTCTCTGCTTACATGATGTCTTGGGTTCGCCAAGCT
21    S  C  A  A  S  G  F  T  F  S  A  Y  M  M  S  W  V  R  Q  A

121  CCTGGTAAAGGTTTGGAGTGGGTTTCTTCTATCTATCCTTCTGGTGGCTATACTTATTAT
41    P  G  K  G  L  E  W  V  S  S  I  Y  P  S  G  G  Y  T  Y  Y

181  GCTGACTCCGTTAAAGGTCGCTTCACTATCTCTAGAGACAACTCTAAGAATACTCTCTAC
61    A  D  S  V  K  G  R  F  T  I  S  R  D  N  S  K  N  T  L  Y

241  TTGCAGATGAACAGCTTAAGGGCTGAGGACACTGCAGTCTACTATTGTGCGAGAGGCTTA
81    L  Q  M  N  S  L  R  A  E  D  T  A  V  Y  Y  C  A  R  G  L

301  CGGGGAGGTCCTGACTACTGGGGCCAGGGAACCCTGGTCACCGTCTCAAGCGCCTCCACC
101   R  G  G  P  D  Y  W  G  Q  G  T  L  V  T  V  S  S  A  S  T

361  AAGGGCCCATCGGTCTTCCCGCTAGCACCCTCCTCCAAGAGCACCTCTGGGGGCACAGCG
121   K  G  P  S  V  F  P  L  A  P  S  S  K  S  T  S  G  G  T  A

421  GCCCTGGGC    (SEQ ID NO:47)
141   A  L  G    (SEQ ID NO:48)
```

FIG. 18A

VL-PF4 (1-308)
Total amino acid number: 102, MW=10966

```
1    CAAGACATCCAGATGACCCAGTCTCCTTCCACCCTGTCTGCATATGTAGGAGACAGTGTC
1     Q  D  I  Q  M  T  Q  S  P  S  T  L  S  A  Y  V  G  D  S  V

61   ACCATCACTTGCCGGGCCAGTCAGAGTGTGAGAAGGTCGTTGGCCTGGTATCAGCAGAGA
21    T  I  T  C  R  A  S  Q  S  V  R  R  S  L  A  W  Y  Q  Q  R

121  CCAGGGAAAGCCCCCAAGTCCCTCATCTATAAGGCGTCTACTTTAGAGACTGGGGTCCCA
41    P  G  K  A  P  K  S  L  I  Y  K  A  S  T  L  E  T  G  V  P

181  CCAAGGTTCAGCGGCAGTGGATCTGGGACAGAATTCACTCTCACCATCAGCAGCCTGCAG
61    P  R  F  S  G  S  G  S  G  T  E  F  T  L  T  I  S  S  L  Q

241  CCTGAAGATTCTGCAATTTATTACTGCCAACAATATGGTAGTTTTCCGCTCACTTTCGGC
81    P  E  D  S  A  I  Y  Y  C  Q  Q  Y  G  S  F  P  L  T  F  G

301  GGAGGGAC    (SEQ ID NO:49)
101   G  G       (SEQ ID NO:50)
```

FIG. 18B

```
VH-PG3 (1-441)
Total amino acid number: 147, MW=15647

1     GAAGTTCAATTGTTAGAGTCTGGTGGCGGTCTTGTTCAGCCTGGTGGTTCTTTACGTCTT
1       E  V  Q  L  L  E  S  G  G  G  L  V  Q  P  G  G  S  L  R  L

61    TCTTGCGCTGCTTCCGGATTCACTTTCTCTCATTACATGATGGTTTGGGTTCGCCAAGCT
21      S  C  A  A  S  G  F  T  F  S  H  Y  M  M  V  W  V  R  Q  A

121   CCTGGTAAAGGTTTGGAGTGGGTTTCTTCTATCTATCCTTCTGGTGGCTGGACTTATTAT
41      P  G  K  G  L  E  W  V  S  S  I  Y  P  S  G  G  W  T  Y  Y

181   GCTGACTCCGTTAAAGGTCGCTTCACTATCTCTAGAGACAACTCTAAGAATACTCTCTAC
61      A  D  S  V  K  G  R  F  T  I  S  R  D  N  S  K  N  T  L  Y

241   TTGCAGATGAACAGCTTAAGGGCTGAGGACACTGCAGTCTACTATTGTGCGAGGCTGGAC
81      L  Q  M  N  S  L  R  A  E  D  T  A  V  Y  Y  C  A  R  L  D

301   TACGGTGGTAATTCCGCCTACTTTGACTACTGGGGCCAGGGAACCCTGGTCACCGTCTCA
101     Y  G  G  N  S  A  Y  F  D  Y  W  G  Q  G  T  L  V  T  V  S

361   AGCGCCTCCACCAAGGGCCCATCGGTCTTCCCGCTAGCACCCTCCTCCAAGAGCACCTCT
121     S  A  S  T  K  G  P  S  V  F  P  L  A  P  S  S  K  S  T  S

421   GGGGGCACAGCGGCCCTGGGC      (SEQ ID NO:51)
141     G  G  T  A  A  L  G    (SEQ ID NO:52)
```

FIG. 19A

```
VL-PG3 (1-327)
Total amino acid number: 109, MW=11792

1     CAGAGCGTCTTGACTCAGCCGCACTCTGTGTCGGCCTCTCCGGGGAAGACGGTAACCATC
1       Q  S  V  L  T  Q  P  H  S  V  S  A  S  P  G  K  T  V  T  I

61    TCCTGCACCCGCAGCAGTGGCAACATTGCCAGCAACTTTGTCCAGTGGTACCAACAGCGC
21      S  C  T  R  S  S  G  N  I  A  S  N  F  V  Q  W  Y  Q  Q  R

121   CCGGGCAGTGTCCCCACCACTGTGATTTATGAAGATGACCGAAGACCCTCTGGGGTCCCT
41      P  G  S  V  P  T  T  V  I  Y  E  D  D  R  R  P  S  G  V  P

181   GATCGCTTTTCTGGCTCCATCGACAGTTCCTCCAACTCTGCTTTCCTCAGCATCTCTGGA
61      D  R  F  S  G  S  I  D  S  S  S  N  S  A  F  L  S  I  S  G

241   CTGAAGACTGAGGACGAGGCAGACTATTACTGTCAGTCTCATGATCGTACCACCCGTGCT
81      L  K  T  E  D  E  A  D  Y  Y  C  Q  S  H  D  R  T  T  R  A

301   TGGGTGTTCGGCGGAGGGACCAAGCTG    (SEQ ID NO:53)
101     W  V  F  G  G  G  T  K  L    (SEQ ID NO:54)
```

FIG. 19B

VH-SA2 (1-413)
Total amino acid number: 137, MW=14682

```
1     GAAGTTCAATTGTTAGAGTCTGGTGGCGGTCTTGTTCAGCCTGGTGGTTCTTTACGTCTT
1      E  V  Q  L  L  E  S  G  G  G  L  V  Q  P  G  G  S  L  R  L

61    TCTTGCGCTGCTTCCGGATTCACTTTCTCTCGTTACACTATGATGTGGGTTCGCCAAGCT
21     S  C  A  A  S  G  F  T  F  S  R  Y  T  M  M  W  V  R  Q  A

121   CCTGGTAAAGGTTTGGAGTGGGTTTCTGGTATCTATCCTTCTGGTGGCGTTACTCTTTAT
41     P  G  K  G  L  E  W  V  S  G  I  Y  P  S  G  G  V  T  L  Y

181   GCTGACTCCGTTAAAGGTCGCTTCACTATCTCTAGAGACAACTCTAAGAATACTCTCTAC
61     A  D  S  V  K  G  R  F  T  I  S  R  D  N  S  K  N  T  L  Y

241   TTGCAGATGAACAGCTTAAGGGCTGAGGACACTGCAGTCTACTATTGTGCGAGAGTCAAT
81     L  Q  M  N  S  L  R  A  E  D  T  A  V  Y  Y  C  A  R  V  N

301   TACTATGATAGTAGTGGTTACGGTCCTATAGCTCCTGGACTTGACTACTGGGGCCAGGGA
101    Y  Y  D  S  S  G  Y  G  P  I  A  P  G  L  D  Y  W  G  Q  G

361        ACCCTGGTCACCGTCTCAAGCGCCTCCACCAAGGGCCCATCGGTCTTCCCGCT    (SEQ
ID NO:55)
121         T  L  V  T  V  S  S  A  S  T  K  G  P  S  V  F  P       (SEQ
ID NO:56
```

FIG. 20A

VL-SA2 (1-339)
Total amino acid number: 113, MW=12358

```
1     CACAGTGCACAAGACATCCAGATGACCCAGTCTCCAGGCACCCTGTCTTTGTCTCCAGGG
1      H  S  A  Q  D  I  Q  M  T  Q  S  P  G  T  L  S  L  S  P  G

61    GAAAGAGCCACACTCTCCTGCAGGGCCAGTCGGAGTGTGATCATCAGCTACGTAGCCTGG
21     E  R  A  T  L  S  C  R  A  S  R  S  V  I  I  S  Y  V  A  W

121   TACCAGCAGAAACCTGGCCAGGCTCCCAGGCTCCTCATCTATGGAGCGTCCACCAGGGCC
41     Y  Q  Q  K  P  G  Q  A  P  R  L  L  I  Y  G  A  S  T  R  A

181   ACTGGCATCCCAGACAGGTTCAGTGGCAGTGGGTCTGGGACAGACTTCACTCTCACCATC
61     T  G  I  P  D  R  F  S  G  S  G  S  G  T  D  F  T  L  T  I

241   AGCAGACTGGAGCCTGAAGACTTTGCAGTGTATTTCTGTCAGCTTTATGGTAGGTCACCA
81     S  R  L  E  P  E  D  F  A  V  Y  F  C  Q  L  Y  G  R  S  P

301   CGGATCATCTTCGGCCAAGGGACACGACTGGAGATTAAA    (SEQ ID NO:57)
101    R  I  I  F  G  Q  G  T  R  L  E  I  K    (SEQ ID NO:58)
```

FIG. 20B

```
VH-SA10 (1-369)
Total amino acid number: 123, MW=13314

1      GAAGTTCAATTGTTAGAGTCTGGTGGCGGTCTTGTTCAGCCTGGTGGTTCTTTACGTCTT
1       E  V  Q  L  L  E  S  G  G  G  L  V  Q  P  G  G  S  L  R  L

61     TCTTGCGCTGCTTCCGGATTCACTTTCTCTAATTACGTTATGGTTTGGGTTCGCCAAGCT
21      S  C  A  A  S  G  F  T  F  S  N  Y  V  M  V  W  V  R  Q  A

121    CCTGGTAAAGGTTTGGAGTGGGTTTCTGGTATCTATCCTTCTGGTGGCCATACTAAGTAT
41      P  G  K  G  L  E  W  V  S  G  I  Y  P  S  G  G  H  T  K  Y

181    GCTGACTCCGTTAAAGGTCGCTTCACTATCTCTAGAGACAACTCTAAGAATACTCTCTAC
61      A  D  S  V  K  G  R  F  T  I  S  R  D  N  S  K  N  T  L  Y

241    TTGCAGATGAACAGCTTAAGGGCTGAGGACACTGCAGTCTACTATTGTGCGAGAGTCAAT
81      L  Q  M  N  S  L  R  A  E  D  T  A  V  Y  Y  C  A  R  V  N

301    TACTATGATAGTAGTGGTTACGGTCCTATAGCTCCTGGACTTGACTACTGGGGCCAGGGA
101     Y  Y  D  S  S  G  Y  G  P  I  A  P  G  L  D  Y  W  G  Q  G

361    ACCCTGGTC  (SEQ ID NO:59)
121     T  L  V  (SEQ ID NO:60)
```

FIG. 21A

```
VL-SA10 (1-339)
Total amino acid number: 113, MW=12445

1      CACAGTGCACAAGACATCCAGATGACCCAGTCTCCAGGCACCCTGTCTTTGTCTCCAGGG
1       H  S  A  Q  D  I  Q  M  T  Q  S  P  G  T  L  S  L  S  P  G

61     GAAAGAGCCACCCTCTTCTGCAGGGCCAGTCAGCGTGTTACCAGCAACTCCTTGGCCTGG
21      E  R  A  T  L  F  C  R  A  S  Q  R  V  T  S  N  S  L  A  W

121    TACCAGCAGAGACCTGGCCAGGCTCCCAGGCTCCTCATCTATGATGCATCCACCAGGGCC
41      Y  Q  Q  R  P  G  Q  A  P  R  L  L  I  Y  D  A  S  T  R  A

181    ACTGGCATCCCAGACCGCTTCAGTGGCAGTGGGTCGGGGAGGGACTTCACTCTCACCATC
61      T  G  I  P  D  R  F  S  G  S  G  S  G  R  D  F  T  L  T  I

241    AGCAGACTGGAGCCTGAAGATTTTGCAGTTTATTACTGTCAGCGATATGGTAGTTCAGTG
81      S  R  L  E  P  E  D  F  A  V  Y  Y  C  Q  R  Y  G  S  S  V

301    TTGTACTCTTTTGGCCAGGGGACGAAGTTGGAAATCACA  (SEQ ID NO:61)
101     L  Y  S  F  G  Q  G  T  K  L  E  I  T  (SEQ ID NO:62)
```

FIG. 21B

VH-SB2 (1-383)
Total amino acid number: 127, MW=13611

```
1    GAAGTTCAATTGTTAGAGTCTGGTGGCGGTCTTGTTCAGCCTGGTGGTTCTTTACGTCTT
1     E   V   Q   L   L   E   S   G   G   G   L   V   Q   P   G   G   S   L   R   L

61   TCTTGCGCTGCTTCCGGATTCACTTTCTCTATTTACGGTATGGCTTGGGTTCGCCAAGCT
21    S   C   A   A   S   G   F   T   F   S   I   Y   G   M   A   W   V   R   Q   A

121  CCTGGTAAAGGTTTGGAGTGGGTTTCTGTTATCTCTCCTTCTGGTGGCCAGACTTTTTAT
41    P   G   K   G   L   E   W   V   S   V   I   S   P   S   G   G   Q   T   F   Y

181  GCTGACTCCGTTAAAGGTCGCTTCACTATCTCTAGAGACAACTCTAAGAATACTCTCTAC
61    A   D   S   V   K   G   R   F   T   I   S   R   D   N   S   K   N   T   L   Y

241  TTGCAGATGAACAGCTTAAGGGCTGAGGACACTGCAGTCTACTATTGTGCGAGAGTTTAC
81    L   Q   M   N   S   L   R   A   E   D   T   A   V   Y   Y   C   A   R   V   Y

301  TACTACGGTATGGACGTCTGGGGCCAAGGGACCACGGTCACCGTCTCAAGCGCCTCCACC
101   Y   Y   G   M   D   V   W   G   Q   G   T   T   V   T   V   S   S   A   S   T

361  AAGGGCCCATCGGTCTTCCCGCT       (SEQ ID NO:63)
121   K   G   P   S   V   F   P       (SEQ ID NO:64)
```

FIG. 22A

VL-SB2 (1-333)
Total amino acid number: 111, MW=12221

```
1    CACAGTGCACAAGACATCCAGATGACCCAGTCTCCAGCCACCCTGTCTTTGTCTCCAGGG
1     H   S   A   Q   D   I   Q   M   T   Q   S   P   A   T   L   S   L   S   P   G

61   GAAAGAGCCACCCTCTCCTGCAGGGCCAGTCAGAGTGTTAGCAGCTACTTAGCCTGGTAC
21    E   R   A   T   L   S   C   R   A   S   Q   S   V   S   S   Y   L   A   W   Y

121  CAACAAAAACCTGGCCAGGCTCCCAGGCTCCTCATTTATGATGCATCCAACAGGGCCACT
41    Q   Q   K   P   G   Q   A   P   R   L   L   I   Y   D   A   S   N   R   A   T

181  GGCATCCCAGCCAGGTTCAGTGGCAGTGGGTCTGAGACAGACTTCACTCTCACCATCAGC
61    G   I   P   A   R   F   S   G   S   G   S   E   T   D   F   T   L   T   I   S

241  AGCCTAGAGCCTGAAGATTTTGCAGTTTATTACTGTCAGCAGCGTAGCAAGTGGCCTCGG
81    S   L   E   P   E   D   F   A   V   Y   Y   C   Q   Q   R   S   K   W   P   R

301  ACTTTTGGCCAGGGGACCAAGCTGGAGATCAAA    (SEQ ID NO:65)
101   T   F   G   Q   G   T   K   L   E   I   K       (SEQ ID NO:66)
```

FIG. 22B

VH-SB9 (1-413)
Total amino acid number: 137, MW=14778

```
1     GAAGTTCAATTGTTAGAGTCTGGTGGCGGTCTTGTTCAGCCTGGTGGTTCTTTACGTCTT
1      E   V   Q   L   L   E   S   G   G   G   L   V   Q   P   G   G   S   L   R   L

61    TCTTGCGCTGCTTCCGGATTCACTTTCTCTTCTTACGTTATGATGTGGGTTCGCCAAGCT
21      S   C   A   A   S   G   F   T   F   S   S   Y   V   M   M   W   V   R   Q   A

121   CCTGGTAAAGGTTTGGAGTGGGTTTCTGGTATCTATCCTTCTGGTGGCTGGACTTATTAT
41      P   G   K   G   L   E   W   V   S   G   I   Y   P   S   G   G   W   T   Y   Y

181   ACTGACTCCGTTAAAGGTCGCTTCACTATCTCTAGAGACAACTCTAAGAATACTCTCTAC
61      T   D   S   V   K   G   R   F   T   I   S   R   D   N   S   K   N   T   L   Y

241   TTGCAGATGAACAGCTTAAGGGCTGAGGACACTGCAGTCTACTATTGTGCGAGAGTCAAT
81      L   Q   M   N   S   L   R   A   E   D   T   A   V   Y   Y   C   A   R   V   N

301   TACTATGATAGTAGTGGTTACGGTCCTATAGCTCCTGGACTTGACTACTGGGGCCAGGGA
101     Y   Y   D   S   S   G   Y   G   P   I   A   P   G   L   D   Y   W   G   Q   G

361   ACCCTGGTCACCGTCTCAAGCGCCTCCACCAAGGGCCCATCGGTCTTCCCGCT      (SEQ
ID NO:67)
121     T   L   V   T   V   S   S   A   S   T   K   G   P   S   V   F   P            (SEQ
ID NO:68)
```

FIG. 23A

VL-SB9 (1-336)
Total amino acid number: 112, MW=12010

```
1     CACAGTGCACAAGACATCCAGATGACCCAGTCTCCATCCTCCCTGTCTGCATCTGTTGGA
1      H   S   A   Q   D   I   Q   M   T   Q   S   P   S   S   L   S   A   S   V   G

61    GATAGAGTCACCATCACTTGCCGGGCAAGTCAGAGTGTCAGCAGTCATTTAAGTTGGTTT
21      D   R   V   T   I   T   C   R   A   S   Q   S   V   S   S   H   L   S   W   F

121   CAGCAGAGACCAGGGAAAGCCCCCAACCTCCTGATCTATCATGCATCCAGTTTGCAAAGT
41      Q   Q   R   P   G   K   A   P   N   L   L   I   Y   H   A   S   S   L   Q   S

181   GGGGTCCCATCAAGGTTCAGTGGCAGTGGGTCTGGGACAGATTTCACGCTCACCATCAGC
61      G   V   P   S   R   F   S   G   S   G   S   G   T   D   F   T   L   T   I   S

241   AGTCTGCAACCTGAAGATTTTGCAACTTACTACTGTCAGCAGAGTTACGCTACTTCCTCG
81      S   L   Q   P   E   D   F   A   T   Y   Y   C   Q   Q   S   Y   A   T   S   S

301   ATCACCTTCGGCCAGGGGACACGACTGGACATTAAA    (SEQ ID NO:69)
101     I   T   F   G   Q   G   T   R   L   D   I   K    (SEQ ID NO:70)
```

FIG. 23B

VH-SC2 (1-413)
Total amino acid number: 137, MW=14650

```
1       GAAGTTCAATTGTTAGAGTCTGGTGGCGGTCTTGTTCAGCCTGGTGGTTCTTTACGTCTT
1        E  V  Q  L  L  E  S  G  G  G  L  V  Q  P  G  G  S  L  R  L

61      TCTTGCGCTGCTTCCGGATTCACTTTCTCTCGTTACAAGATGAAGTGGGTTCGCCAAGCT
21       S  C  A  A  S  G  F  T  F  S  R  Y  K  M  K  W  V  R  Q  A

121     CCTGGTAAAGGTTTGGAGTGGGTTTCTGTTATCTATCCTTCTGGTGGCGGTACTGGTTAT
41       P  G  K  G  L  E  W  V  S  V  I  Y  P  S  G  G  G  T  G  Y

181     GCTGACTCCGTTAAAGGTCGCTTCACTATCTCTAGAGACAACTCTAAGAATACTCTCTAC
61       A  D  S  V  K  G  R  F  T  I  S  R  D  N  S  K  N  T  L  Y

241     TTGCAGATGAACAGCTTAAGGGCTGAGGACACTGCAGTCTACTATTGTGCGAGAGTCAAT
81       L  Q  M  N  S  L  R  A  E  D  T  A  V  Y  Y  C  A  R  V  N

301     TACTATGATAGTAGTGGTTACGGTCCTATAGCTCCTGGACTTGACTACTGGGGCCAGGGA
101      Y  Y  D  S  S  G  Y  G  P  I  A  P  G  L  D  Y  W  G  Q  G

361     ACCCTGGTCACCGTCTCAAGCGCCTCCACCAAGGGCCCATCGGTCTTCCCGCT(SQN:71)
121      T  L  V  T  V  S  S  A  S  T  K  G  P  S  V  F  P (SQ NO:72)
```

FIG. 24A

VL-SC2 (1-428)
Total amino acid number: 142, MW=15044

```
1       CACAGTGCACAGAGCGTCTTGACTCAGCCTGACTCCGTGTCTGGGTCTCCTGGAGAGTCG
1        H  S  A  Q  S  V  L  T  Q  P  D  S  V  S  G  S  P  G  E  S

61      ATCACCATCTCCTGCACTGGAAGCAGCAGAGACGTTGGTGGTTATAACTATGTCTCCTGG
21       I  T  I  S  C  T  G  S  S  R  D  V  G  G  Y  N  Y  V  S  W

121     TACCAACAACACCCAGGCAAAGCCCCCAAACTCTTGCTTTATGATGTCACTTATCGGCCC
41       Y  Q  Q  H  P  G  K  A  P  K  L  L  L  Y  D  V  T  Y  R  P

181     TCAGGGATTTCTGGTCGCTTCTCTGGCTCCAAGTCTGGCGACACGGCCTCCCTGACCATC
61       S  G  I  S  G  R  F  S  G  S  K  S  G  D  T  A  S  L  T  I

241     TCTGGGCTCCGGACTGAGGACGAGGCTGATTATTACTGCAGCTCATCTATAGGCACCAGG
81       S  G  L  R  T  E  D  E  A  D  Y  Y  C  S  S  S  I  G  T  R

301     ACTTATGTCTTCGGAAGTGGGACCAAGGTCACCGTCCTACGTCAGCCCAAGGCCAACCCC
101      T  Y  V  F  G  S  G  T  K  V  T  V  L  R  Q  P  K  A  N  P

361     ACTGTCACTCTGTTCCCGCCCTCCTCTGAGGAGCTCCAAGCCAACAAGGCCACACTAGTG
121      T  V  T  L  F  P  P  S  S  E  E  L  Q  A  N  K  A  T  L  V

421     TGTCTGAT   (SEQ ID NO:73)
141      C  L     (SEQ ID NO:74)
```

FIG. 24B

VH-SC7 (1-386)
Total amino acid number: 128, MW=13785

```
1      GAAGTTCAATTGTTAGAGTCTGGTGGCGGTCTTGTTCAGCCTGGTGGTTCTTTACGTCTT
1       E  V  Q  L  L  E  S  G  G  G  L  V  Q  P  G  G  S  L  R  L

61     TCTTGCGCTGCTTCCGGATTCACTTTCTCTCGTTACGTTATGTATTGGGTTCGCCAAGCT
21      S  C  A  A  S  G  F  T  F  S  R  Y  V  M  Y  W  V  R  Q  A

121    CCTGGTAAAGGTTTGGAGTGGGTTTCTGTTATCTATCCTTCTGGTGGCGCTACTTATTAT
41      P  G  K  G  L  E  W  V  S  V  I  Y  P  S  G  G  A  T  Y  Y

181    GCTGACTCCGTTAAAGGTCGCTTCACTATCTCTAGAGACAACTCTAAGAATACTCTCTAC
61      A  D  S  V  K  G  R  F  T  I  S  R  D  N  S  K  N  T  L  Y

241    TTGCAGATGAACAGCTTAAGGGCTGAGGACACTGCAGTCTACTATTGTGCGAGACGGGGA
81      L  Q  M  N  S  L  R  A  E  D  T  A  V  Y  Y  C  A  R  R  G

301    AGTAGTGGTGCGTTTGACTACTGGGGCCAGGGAACCCTGGTCACCGTCTCAAGCGCCTCC
101     S  S  G  A  F  D  Y  W  G  Q  G  T  L  V  T  V  S  S  A  S

361    ACCAAGGGCCCATCGGTCTTCCCGCT    (SEQ ID NO:75)
121     T  K  G  P  S  V  F  P      (SEQ ID NO:76)
```

FIG. 25A

VL-SC7 (1-434)
Total amino acid number: 144, MW=15027

```
1      CACAGTGCACAGAGCGTCTTGACTCAGCCTGCCTCCGTGTCTGGGTCTCCTGGACAGTCG
1       H  S  A  Q  S  V  L  T  Q  P  A  S  V  S  G  S  P  G  Q  S

61     ATCACCATCTCCTGCACTGGAACCAGCAGTGACATTGGTCGTTATAACTATGCCTCCTGG
21      I  T  I  S  C  T  G  T  S  S  D  I  G  R  Y  N  Y  A  S  W

121    TACCAACAACGCCCAGGCAAATCCCCCAAACTCCTGATTTATGAGGTCAGTGATCGGCCC
41      Y  Q  Q  R  P  G  K  S  P  K  L  L  I  Y  E  V  S  D  R  P

181    TCAGGGGTTTCTAATCGCTTCTCTGGCTCCAAGTCTGGCAACACGGCCTCCCTGATCATC
61      S  G  V  S  N  R  F  S  G  S  K  S  G  N  T  A  S  L  I  I

241    TCTGGGCTCCAGGCTGAGGACGAGGCTGATTATTACTGCAGCTCATATTCAAGCACCAAC
81      S  G  L  Q  A  E  D  E  A  D  Y  Y  C  S  S  Y  S  S  T  N

301    AGTCTCCAAGTGGTATTCGGCGGAGGGACCAAGCTGAGCGTCCTAGGTCAGCCCAAGGCT
101     S  L  Q  V  V  F  G  G  G  T  K  L  S  V  L  G  Q  P  K  A

361    GCCCCCTCGGTCACTCTGTTCCCGCCCTCCTCTGAGGAGCTTCAAGCCAACAAGGCCACA
121     A  P  S  V  T  L  F  P  P  S  S  E  E  L  Q  A  N  K  A  T

421    CTGGTGTGTCTCAT    (SEQ ID NO:77)
141     L  V  C  L     (SEQ ID NO:78)
```

FIG. 25B

VH-SC10 (1-413)
Total amino acid number: 137, MW=14688

```
1     GAAGTTCAATTGTTAGAGTCTGGTGGCGGTCTTGTTCAGCCTGGTGGTTCTTTACGTCTT
1      E  V  Q  L  L  E  S  G  G  G  L  V  Q  P  G  G  S  L  R  L

61    TCTTGCGCTGCTTCCGGATTCACTTTCTCTGCTTACGGTATGTCTTGGGTTCGCCAAGCT
21     S  C  A  A  S  G  F  T  F  S  A  Y  G  M  S  W  V  R  Q  A

121   CCTGGTAAAGGTTTGGAGTGGGTTTCTGTTATCTATCCTTCTGGTGGCTGGACTTATTAT
41     P  G  K  G  L  E  W  V  S  V  I  Y  P  S  G  G  W  T  Y  Y

181   GCTGACTCCGTTAAAGGTCGCTTCACTATCTCTAGAGACAACTCTAAGAATACTCTCTAC
61     A  D  S  V  K  G  R  F  T  I  S  R  D  N  S  K  N  T  L  Y

241   TTGCAGATGAACAGCTTAAGGGCTGAGGACACTGCAGTCTACTATTGTGCGAGAGTCAAT
81     L  Q  M  N  S  L  R  A  E  D  T  A  V  Y  Y  C  A  R  V  N

301   TACTATGATAGTAGTGGTTACGGTCCTATAGCTCCTGGACTTGACTACTGGGGCCAGGGA
101    Y  Y  D  S  S  G  Y  G  P  I  A  P  G  L  D  Y  W  G  Q  G

361   ACCCTGGTCACCGTCTCAAGCGCCTCCACCAAGGGCCCATCGGTCTTCCCGCT   (SEQ
ID NO:79)
121    T  L  V  T  V  S  S  A  S  T  K  G  P  S  V  F  P   (SEQ ID
NO:80)
```

FIG. 26A

VL-SC10 (1-336)
Total amino acid number: 112, MW=12256

```
1     CACAGTGCACAAGACATCCAGATGACCCAGTCTCCAGGCACCCTGTCTTTGTCTCCAGGG
1      H  S  A  Q  D  I  Q  M  T  Q  S  P  G  T  L  S  L  S  P  G

61    GAAAGAGCCACCCTCTCCTGCAGGGCCAGTCAGAGTGTTAGCAGCAGCTACTTAGCCTGG
21     E  R  A  T  L  S  C  R  A  S  Q  S  V  S  S  S  Y  L  A  W

121   TACCAGCAGAAACCTGGCCAGGCTCCCAGGCTCCTCATCTATGGTGCATCCAGCAGGGCC
41     Y  Q  Q  K  P  G  Q  A  P  R  L  L  I  Y  G  A  S  S  R  A

181   ACTGGCATCCCAGACAGGTTCAGTGGCAGTGGGTCTGGGACAGACTTCACTCTCACCATC
61     T  G  I  P  D  R  F  S  G  S  G  S  G  T  D  F  T  L  T  I

241   AGCAGACTGGAGCCTGAAGATTTTGCAGTGTATTACTGTCAGCAGTATAATAACTGGCCT
81     S  R  L  E  P  E  D  F  A  V  Y  Y  C  Q  Q  Y  N  N  W  P

301   CGGACGTTCGGCCAAGGGACCAAGGTGGAAATCAAA   (SEQ ID NO:81)
101    R  T  F  G  Q  G  T  K  V  E  I  K   (SEQ ID NO:82)
```

FIG. 26B

VH-SD11 (1-395)
Total amino acid number: 131, MW=14005

```
1      GAAGTTCAATTGTTAGAGTCTGGTGGCGGTCTTGTTCAGCCTGGTGGTTCTTTACGTCTT
1       E  V  Q  L  L  E  S  G  G  G  L  V  Q  P  G  G  S  L  R  L

61     TCTTGCGCTGCTTCCGGATTCACTTTCTCTGGTTACGCTATGTGGTGGGTTCGCCAAGCT
21      S  C  A  A  S  G  F  T  F  S  G  Y  A  M  W  W  V  R  Q  A

121    CCTGGTAAAGGTTTGGAGTGGGTTTCTTCTATCTCTCCTTCTGGTGGCGCTACTGCTTAT
41      P  G  K  G  L  E  W  V  S  S  I  S  P  S  G  G  A  T  A  Y

181    GCTGACTCCGTTAAAGGTCGCTTCACTATCTCTAGAGACAACTCTAAGAATACTCTCTAC
61      A  D  S  V  K  G  R  F  T  I  S  R  D  N  S  K  N  T  L  Y

241    TTGCAGATGAACAGCTTAAGGGCTGAGGACACTGCAGTCTACTATTGTGCGAGAGATGCG
81      L  Q  M  N  S  L  R  A  E  D  T  A  V  Y  Y  C  A  R  D  A

301    GGGAGTTATTATTGGGGCTGGTTCGACCCCTGGGGCCAGGGAACCCTGGTCACCGTCTCA
101     G  S  Y  Y  W  G  W  F  D  P  W  G  Q  G  T  L  V  T  V  S

361    AGCGCCTCCACCAAGGGCCCATCGGTCTTCCCGCT    (SEQ ID NO:83)
121     S  A  S  T  K  G  P  S  V  F  P       (SEQ ID NO:84)
```

FIG. 27A

VL-SD11 (1-333)
Total amino acid number: 111, MW=12194

```
1      CACAGTGCACAAGACATCCAGATGACCCAGTCTCCAGCCACCTTGTCTTTGTCTCCAGGG
1       H  S  A  Q  D  I  Q  M  T  Q  S  P  A  T  L  S  L  S  P  G

61     GAAAGAGCCACCCTCTCCTGCAGGGCCAGTCAGAGTATTAGCAGCTACTTAGCCTGGTAC
21      E  R  A  T  L  S  C  R  A  S  Q  S  I  S  S  Y  L  A  W  Y

121    CAACAGAAACCTGGCCAGCCTCCCAGGCTCCTCATCTATGATGCATCCAGCAGGGTTACT
41      Q  Q  K  P  G  Q  P  P  R  L  L  I  Y  D  A  S  S  R  V  T

181    GGCATCCCAGCCAGGTTCAGTGGCAGTGGCTTTGGGACAGACTTCACTCTCACCATTAGT
61      G  I  P  A  R  F  S  G  S  G  F  G  T  D  F  T  L  T  I  S

241    AGCCTGGAGCCTGAAGATTTTGCAGTTTATTACTGTCTCCAGCGTAGCAGCTGGCCCCGA
81      S  L  E  P  E  D  F  A  V  Y  Y  C  L  Q  R  S  S  W  P  R

301    ACTTTTGGCCAGGGGACCAAGCTGGAGATCAAA    (SEQ ID NO:85)
101     T  F  G  Q  G  T  K  L  E  I  K      (SEQ ID NO:86)
```

FIG. 27B

VH-SE11 (1-413)
Total amino acid number: 137, MW=14670

```
1     GAAGTTCAATTGTTAGAGTCTGGTGGCGGTCTTGTTCAGCCTGGTGGTTCTTTACGTCTT
1       E  V  Q  L  L  E  S  G  G  G  L  V  Q  P  G  G  S  L  R  L

61    TCTTGCGCTGCTTCCGGATTCACTTTCTCTGGTTACGTTATGTTTTGGGTTCGCCAAGCT
21      S  C  A  A  S  G  F  T  F  S  G  Y  V  M  F  W  V  R  Q  A

121   CCTGGTAAAGGTTTGGAGTGGGTTTCTGGTATCTATCCTTCTGGTGGCTGGACTGTTTAT
41      P  G  K  G  L  E  W  V  S  G  I  Y  P  S  G  G  W  T  V  Y

181   GCTGACTCCGTTAAAGGTCGCTTCACTATCTCTAGAGACAACTCTAAGAATACTCTCTAC
61      A  D  S  V  K  G  R  F  T  I  S  R  D  N  S  K  N  T  L  Y

241   TTGCAGATGAACAGCTTAAGGGCTGAGGACACTGCAGTCTACTATTGTGCGAGAGTCAAT
81      L  Q  M  N  S  L  R  A  E  D  T  A  V  Y  Y  C  A  R  V  N

301   TACTATGATAGTAGTGGTTACGGTCCTATAGCTCCTGGACTTGACTACTGGGGCCAGGGA
101     Y  Y  D  S  S  G  Y  G  P  I  A  P  G  L  D  Y  W  G  Q  G

361   ACCCTGGTCACCGTCTCAAGCGCCTCCACCAAGGGCCCATCGGTCTTCCCGCT   (SEQ
ID NO:87)
121     T  L  V  T  V  S  S  A  S  T  K  G  P  S  V  F  P  (SEQ ID
NO:88)
```

FIG. 28A

VL-SE11 (1-333)
Total amino acid number: 111, MW=11962

```
1     CACAGTGCACAAGACATCCAGATGACCCAGTCTCCAGGCACCCTGTCTTTGTCTCCAGGG
1       H  S  A  Q  D  I  Q  M  T  Q  S  P  G  T  L  S  L  S  P  G

61    GAAAGAGCCACCCTCTCCTGCAGGGCCAGTCAGAGTGTTAGCAGCAGCTACTTAGCCTGG
21      E  R  A  T  L  S  C  R  A  S  Q  S  V  S  S  S  Y  L  A  W

121   TACCAGCAGAAACCTGGCCAGGCTCCCAGGCTCCTCATCTATGGTGCATCCAGCAGGGCC
41      Y  Q  Q  K  P  G  Q  A  P  R  L  L  I  Y  G  A  S  S  R  A

181   ACTGGCATCCCAGACAGGTTCAGTGGCAGTGGGTCTGGGACAGACTTCACTCTCACCATC
61      T  G  I  P  D  R  F  S  G  S  G  S  G  T  D  F  T  L  T  I

241   AGCAGACTGGAGCCTGAAGATTTTGCAGTGTATTACTGTCAGCAATATGGTAGCTCACGG
81      S  R  L  E  P  E  D  F  A  V  Y  Y  C  Q  Q  Y  G  S  S  R

301   ACGTTCGGCCAAGGGACCAACGTGGAAATCAAA   (SEQ ID NO:89)
101     T  F  G  Q  G  T  N  V  E  I  K  (SEQ ID NO:90)
```

FIG. 28B

VH-SG4 (1-395)
Total amino acid number: 131, MW=14168

```
1    GAAGTTCAATTGTTAGAGTCTGGTGGCGGTCTTGTTCAGCCTGGTGGTTCTTTACGTCTT
1     E  V  Q  L  L  E  S  G  G  G  L  V  Q  P  G  G  S  L  R  L

61   TCTTGCGCTGCTTCCGGATTCACTTTCTCTTCTTACATGATGACTTGGGTTCGCCAAGCT
21    S  C  A  A  S  G  F  T  F  S  S  Y  M  M  T  W  V  R  Q  A

121  CCTGGTAAAGGTTTGGAGTGGGTTTCTTCTATCTATCCTTCTGGTGGCTATACTTATTAT
41    P  G  K  G  L  E  W  V  S  S  I  Y  P  S  G  G  Y  T  Y  Y

181  GCTGACTCCGTTAAAGGTCGCTTCACTATCTCTAGAGACAACTCTAAGAATACTCTCTAC
61    A  D  S  V  K  G  R  F  T  I  S  R  D  N  S  K  N  T  L  Y

241  TTGCAGATGAACAGCTTAAGGGCTGAGGACACTGCAGTCTACTATTGTGCGAGAGGAGGG
81    L  Q  M  N  S  L  R  A  E  D  T  A  V  Y  Y  C  A  R  G  G

301  TATGGCGACTCGTCATTTTTTTTTGACTACTGGGGCCAGGGAACCCTGGTCACCGTCTCA
101   Y  G  D  S  S  F  F  F  D  Y  W  G  Q  G  T  L  V  T  V  S

361  AGCGCCTCCACCAAGGGCCCATCGGTCTTCCCGCT    (SEQ ID NO:91)
121   S  A  S  T  K  G  P  S  V  F  P   (SEQ ID NO:92)
```

FIG. 29A

VL-SG4 (1-333)
Total amino acid number: 111, MW=11832

```
1    CACAGTGCACAAGACATCCAGATGACCCAGTCTCCAGCCACCCTGTCTGTGTCTCCAGGG
1     H  S  A  Q  D  I  Q  M  T  Q  S  P  A  T  L  S  V  S  P  G

61   GAAGGAGCCACCCTCTCTTGCAGGGCCAGTCGGAGTGTTGGCAGCAACTTAGCCTGGTAC
21    E  G  A  T  L  S  C  R  A  S  R  S  V  G  S  N  L  A  W  Y

121  CAGCAGAAGCCTGGCCAGGCTCCCAGGCTCCTCATCTATGATGCATCCACCAGGGCCACT
41    Q  Q  K  P  G  Q  A  P  R  L  L  I  Y  D  A  S  T  R  A  T

181  GGTATCCCCGCCAGGTTCAGTGGCAGTGGGTCTGGGACAAAGTTCACTCTCACCATCAGC
61    G  I  P  A  R  F  S  G  S  G  S  G  T  K  F  T  L  T  I  S

241  AGCCTCCAGTCTGAAGATTTTGCAGTTTATTACTGTCAGCAGCGTAGCAATTGGCCTCTC
81    S  L  Q  S  E  D  F  A  V  Y  Y  C  Q  Q  R  S  N  W  P  L

301  ACTTTCGGCGGAGGGACCAAGGTGGAGATCAAA  (SEQ ID NO:93)
101   T  F  G  G  G  T  K  V  E  I  K  (SEQ ID NO:94)
```

FIG. 29B

VL-SG9 (1-428)
Total amino acid number: 142, MW=14993
Max ORF: 1-426, 142 AA, MW=14993

```
  1    CACAGTGCACAGAGCGTCTTGACTCAGCCTGCCTCCGTGTCTGGGTCTCCTGGACAGTCG
  1      H  S  A  Q  S  V  L  T  Q  P  A  S  V  S  G  S  P  G  Q  S

61    ATCACCATCTCCTGCACTGGAACCAGCAGTGACGTTGGTGATGATAACTATGTCTCCTGG
 21      I  T  I  S  C  T  G  T  S  S  D  V  G  D  D  N  Y  V  S  W

121    TACCAACAACACCCAGACAAAGCCCCCAAACTCATGATTTATGAGGTCAGTTATCGGCCC
 41      Y  Q  Q  H  P  D  K  A  P  K  L  M  I  Y  E  V  S  Y  R  P

181    TCAGGGGTTTCTAATCGCTTCTCTGGCTCCAAGTCTGGCAACACGGCCTCCCTGACCATC
 61      S  G  V  S  N  R  F  S  G  S  K  S  G  N  T  A  S  L  T  I

241    TCTGGGCTCCAGACTGAGGACGAGGCTGATTATTATTGCGGCTCATATCGCGTCAGCAGC
 81      S  G  L  Q  T  E  D  E  A  D  Y  Y  C  G  S  Y  R  V  S  S

301    TCCTATGTCTTCGGAACTGGGACCAAGGTCACCGTCCTAGGTCAGCCCAAGGCCAACCCC
101      S  Y  V  F  G  T  G  T  K  V  T  V  L  G  Q  P  K  A  N  P

361    ACTGTCACTCTGTTCCCGCCCTCCTCTGAGGAGCTCCAAGCCAACAAGGCCACACTAGTG
121      T  V  T  L  F  P  P  S  S  E  E  L  Q  A  N  K  A  T  L  V

421    TGTCTGAT    (SEQ ID NO:95)
141      C  L    (SEQ ID NO:96)
```

FIG. 30

VH-SG10 (1-363)
Total amino acid number: 121, MW=13390

```
1      GAAGTTCAATTGTTAGAGTCTGGTGGCGGTCTTGTTCAGCCTGGTGGTTCTTTACGTCTT
1       E  V  Q  L  L  E  S  G  G  G  L  V  Q  P  G  G  S  L  R  L

61     TCTTGCGCTGCTTCCGGATTCACTTTCTCTCGTTACAAGATGTTTTGGGTTCGCCAAGCT
21       S  C  A  A  S  G  F  T  F  S  R  Y  K  M  F  W  V  R  Q  A

121    CCTGGTAAAGGTTTGGAGTGGGTTTCTGTTATCTATCCTTCTGGTGGCCCTACTATGTAT
41       P  G  K  G  L  E  W  V  S  V  I  Y  P  S  G  G  P  T  M  Y

181    GCTGACTCCGTTAAAGGTCGCTTCACTATCTCTAGAGACAACTCTAAGAATACTCTCTAC
61       A  D  S  V  K  G  R  F  T  I  S  R  D  N  S  K  N  T  L  Y

241    TTGCAGATGAACAGCTTAAGGGCTGAGGACACTGCAGTCTACTATTGTGCGAGAGGGATG
81       L  Q  M  N  S  L  R  A  E  D  T  A  V  Y  Y  C  A  R  G  M

301    GTCCGTGGATATAGTGGCTACGATTACCCTTTCTTGGACTACTGGGGCCAGGGAACCCTG
101      V  R  G  Y  S  G  Y  D  Y  P  F  L  D  Y  W  G  Q  G  T  L

361    GTC   (SEQ ID NO:97)
121     V    (SEQ ID NO:98)
```

FIG. 31A

VL-SG10 (1-333)
Total amino acid number: 111, MW=11981

```
1      CACAGTGCACAAGACATCCAGATGACCCAGTCTCCATCTTCCCTGTCTGCATCTGTAGGG
1       H  S  A  Q  D  I  Q  M  T  Q  S  P  S  S  L  S  A  S  V  G

61     GACAGAGTCACCATCACTTGCCGAGCAAGTCAGACCATTAGCAGCTATTTAAATTGGTAT
21       D  R  V  T  I  T  C  R  A  S  Q  T  I  S  S  Y  L  N  W  Y

121    CAGCAGAAGCCAGGGAAAGCCCCTAAGCTCCTGATCTATGCTGCATCCAGTTTGCAAAGT
41       Q  Q  K  P  G  K  A  P  K  L  L  I  Y  A  A  S  S  L  Q  S

181    GGGGTCCCATCAAGGTTCAGTGGCAGTGGATCTGGGACAGATTTCACTCTCACCATCAGC
61       G  V  P  S  R  F  S  G  S  G  S  G  T  D  F  T  L  T  I  S

241    AGTCTGCAACCTGAAGATTTTGCAACTTACTACTGTCAACAGAGTTACAGTACCCCTCGT
81       S  L  Q  P  E  D  F  A  T  Y  Y  C  Q  Q  S  Y  S  T  P  R

301    ACGTTCGGCCAAGGGACCAAGGTGGAAATCAAA   (SEQ ID NO:99)
101      T  F  G  Q  G  T  K  V  E  I  K    (SEQ ID NO:100)
```

FIG. 31B

VH-SH1 (1-386)
Total amino acid number: 128, MW=13767

| | |
|---|---|
| 1 | GAAGTTCAATTGTTAGAGTCTGGTGGCGGTCTTGTTCAGCCTGGTGGTTCTTTACGTCTT |
| 1 | E V Q L L E S G G G L V Q P G G S L R L |
| 61 | TCTTGCGCTGCTTCCGGATTCACTTTCTCTGCTTACCAGATGGTTTGGGTTCGCCAAGCT |
| 21 | S C A A S G F T F S A Y Q M V W V R Q A |
| 121 | CCTGGTAAAGGTTTGGAGTGGGTTTCTTCTATCTATCCTTCTGGTGGCTGGACTTATTAT |
| 41 | P G K G L E W V S S I Y P S G G W T Y Y |
| 181 | GCTGACTCCGTTAAAGGTCGCTTCACTATCTCTAGAGACAACTCTAAGAATACTCTCTAC |
| 61 | A D S V K G R F T I S R D N S K N T L Y |
| 241 | TTGCAGATGAACAGCTTAAGGGCTGAGGACACTGCAGTCTACTATTGTGCGAGAGGCACG |
| 81 | L Q M N S L R A E D T A V Y Y C A R G T |
| 301 | CACCTCCCGGGGGTTGACTACTGGGGCCAGGGAACCCTGGTCACCGTCTCAAGCGCCTCC |
| 101 | H L P G V D Y W G Q G T L V T V S S A S |
| 361 | ACCAAGGGCCCATCGGTCTTCCCGCT (SEQ ID NO:101) |
| 121 | T K G P S V F P (SEQ ID NO:102) |

FIG. 32A

VL-SH1 (1-339)
Total amino acid number: 113, MW=12225

| | |
|---|---|
| 1 | CACAGTGCACAAGACATCCAGATGACCCAGTCTCCAGGCACCCTGTCTTTGTCTCCAGGG |
| 1 | H S A Q D I Q M T Q S P G T L S L S P G |
| 61 | GAAAGAGCCACCCTCTCCTGCAGGGCCAGTCAGAGTGTTAGCAGCAGCTACTTAGCCTGG |
| 21 | E R A T L S C R A S Q S V S S S Y L A W |
| 121 | TACCAGCAGAAACCTGGCCAGGCTCCCAGGCTCCTCATCTATGGTGCATCCAGCAGGGCC |
| 41 | Y Q Q K P G Q A P R L L I Y G A S S R A |
| 181 | ACTGGCATCCCAGACAGGTTCAGTGGCAGTGGGTCTGGGACAGACTTCACTCTCACCATC |
| 61 | T G I P D R F S G S G S G T D F T L T I |
| 241 | AGCAGACTGGAGCCTGAAGATTTTGCAGTGTATTACTGTCAGCAGTATGGTAGCTCCCCC |
| 81 | S R L E P E D F A V Y Y C Q Q Y G S S P |
| 301 | ATGTACACTTTTGGCCAGGGGACCAAGCTGGAGATCAAA (SEQ ID NO:103) |
| 101 | M Y T F G Q G T K L E I K (SEQ ID NO:104) |

FIG. 32B

VH-SH4 (1-339)
Total amino acid number: 113, MW=12481

```
1    GAAGTTCAATTGTTAGAGTCTGGTGGCGGTCTTGTTCAGCCTGGTGGTTCTTTACGTCTT
1     E  V  Q  L  L  E  S  G  G  G  L  V  Q  P  G  G  S  L  R  L

61   TCTTGCGCTGCTTCCGGATTCACTTTCTCTTCTTACAAGATGGGTTGGGTTCGCCAAGCT
21    S  C  A  A  S  G  F  T  F  S  S  Y  K  M  G  W  V  R  Q  A

121  CCTGGTAAAGGTTTGGAGTGGGTTTCTTCTATCTATCCTTCTGGTGGCTGGACTCATTAT
41    P  G  K  G  L  E  W  V  S  S  I  Y  P  S  G  G  W  T  H  Y

181  GCTGACTCCGTTAAAGGTCGCTTCACTATCTCTAGAGACAACTCTAAGAATACTCTCTAC
61    A  D  S  V  K  G  R  F  T  I  S  R  D  N  S  K  N  T  L  Y

241  TTGCAGATGAACAGCTTAAGGGCTGAGGACACTGCAGTCTACTATTGTGCAAGAGTACTA
81    L  Q  M  N  S  L  R  A  E  D  T  A  V  Y  Y  C  A  R  V  L

301  CTACACTACTTTGACTACTGGGGCCAGGGAACCCTGGTC    (SEQ ID NO:105)
101   L  H  Y  F  D  Y  W  G  Q  G  T  L  V    (SEQ ID NO:106)
```

FIG. 33A

VL-SH4 (1-415)
Total amino acid number: 138, MW=14287

```
1    CACAGTGCACAGAGCGTCTTGACTCAGCCTGCCTCCGTGTCTGGGTCTCCTGGACAGTCG
1     H  S  A  Q  S  V  L  T  Q  P  A  S  V  S  G  S  P  G  Q  S

61   ATCACCATCTCCTGCACTGGAACCAGCAGTGACGTTGGTGGTTATAAATATGTCTCCTGG
21    I  T  I  S  C  T  G  T  S  S  D  V  G  G  Y  K  Y  V  S  W

121  TACCAACAGCACCCAGGCAAAGCCCCCAAACTCATTATTTCTGACGTCAATAATCGGCCC
41    Y  Q  Q  H  P  G  K  A  P  K  L  I  I  S  D  V  N  N  R  P

181  TCAGGGGTTTCTGATCGCTTCTCTGGCTCCAAGTCTGGCAACACGGCCTCCCTGACCATC
61    S  G  V  S  D  R  F  S  G  S  K  S  G  N  T  A  S  L  T  I

241  TCTGGGCTCCAGGCTGAGGACGACGGTGATTATTACTGCAGTTCCTACGCAAGTAGTTCC
81    S  G  L  Q  A  E  D  D  G  D  Y  Y  C  S  S  Y  A  S  S  S

301  TATACAAGCAGTACCACTTGGGTGTTCGGCGGGGGGACCAAGCTGACCGTCCTAGGTCAG
101   Y  T  S  S  T  T  W  V  F  G  G  G  T  K  L  T  V  L  G  Q

361  CCCAAGGCTGCCCCCTTGGTCACTCTGTTCCCACCCTCCTCTGAGGAGCTTCAAG    (SEQ
ID NO:107)
121   P  K  A  A  P  L  V  T  L  F  P  P  S  S  E  E  L  Q    (SEQ
ID NO:108)
```

FIG. 33B

VH G2
Total amino acid number: 157, MW=16967

```
                   ---------------------------Fr1-----------------------------
1       GAAGTTCAATTGTTAGAGTCTGGTGGCGGTCTTGTTCAGCCTGGTGGTTCTTTACGTCTT
1        E  V  Q  L  L  E  S  G  G  G  L  V  Q  P  G  G  S  L  R  L

----------------Fr1----------|....CDR1......|-----Fr2-------
61      TCTTGCGCTGCTTCCGGATTCACTTTCTCTTCTTACAAGATGGGTTGGGTTCGCCAAGCT
21       S  C  A  A  S  G  F  T  F  S  S  Y  K  M  G  W  V  R  Q  A

-------------Fr2----------|...........CDR2.................
121     CCTGGTAGAGGTTTGGAGTGGGTTTCTTCTATCTATCCTTCTGGTGGCTGGACTCATTAT
41       P  G  R  G  L  E  W  V  S  S  I  Y  P  S  G  G  W  T  H  Y

......CDR2.......|-----------------Fr3----------------------
181     GCTGACTCCGTTAAAGGTCGCTTCACTATCTCTAGAGACAACTCTAAGAATACTCTCTAC
61       A  D  S  V  K  G  R  F  T  I  S  R  D  N  S  K  N  T  L  Y

-----------------------Fr3--------------------------|.CDR3.
241     TTGCAGATGAACAGCTTAAGGGCTGAGGACACTGCAGTCTACTATTGTGCAAGAGTACTA
81       L  Q  M  N  S  L  R  A  E  D  T  A  V  Y  Y  C  A  R  V  L

.......CDR3......|--------------Fr4-----------------
301     CTACACTACTTTGACTACTGGGGCCAGGGAACCCTGGTCACCGTCTCAAGCGCCTCCACC
101      L  H  Y  F  D  Y  W  G  Q  G  T  L  V  T  V  S  S  A  S  T

361     AAGGGCCCATCGGTCTTCCCCCTGGCACCCTCCTCCAAGAGCACCTCGGGGGCACAGCGG
121      K  G  P  S  V  F  P  L  A  P  S  S  K  S  T  S  G  A  Q  R

421     CCCTGGGCTGCCTGGTCAAGGACTACTTCCCGCGATACCGGTGACGGTGTC   (SEQ ID
NO:109)
141      P  W  A  A  W  S  R  T  T  S  R  D  T  G  D  G  V   (SEQ ID
NO:110)
```

FIG. 34A

C3-G2_pUCrev(1-325)
Total amino acid number: 108, MW=11191
Max ORF: 1-324, 108 AA, MW=11191

T-G2-Tie1-lambda-light
2a2.272A12/DPL11

```
        ------------------------------Fr1-----------------------------
  1     CAGAGCGTCTTGACTCAGCCTGCCTCCGTGTCTGGGTCTCCTGGACAGTCGATCACCATC
  1       Q   S   V   L   T   Q   P   A   S   V   S   G   S   P   G   Q   S   I   T   I

-Fr1-|......................CDR1.................|----Fr2-----
 61     TCCTGCACTGGAACCAGCAGTGACGTTGGTGGTTATAAATATGTCTCCTGGTACCAACAG
 21       S   C   T   G   T   S   S   D   V   G   G   Y   K   Y   V   S   W   Y   Q   Q

-------------Fr2----------------|.........CDR2.......|-Fr3--
121     CACCCAGGCAAAGCCCCCAAACTCATTATTTCTGACGTCAATAATCGGCCCTCAGGGGTT
 41       H   P   G   K   A   P   K   L   I   I   S   D   V   N   N   R   P   S   G   V

------------------------------Fr3-----------------------------
181     TCTGATCGCTTCTCTGGCTCCAAGTCTGGCAACACGGCCTCCCTGACCATCTCTGGGCTC
 61       S   D   R   F   S   G   S   K   S   G   N   T   A   S   L   T   I   S   G   L

---------------Fr3-----------|...............CDR3............
241     CAGGCTGAGGACGACGGTGATTATTACTGCAGTTCCTACGCAAGTAGTTCCTATACAAGC
 81       Q   A   E   D   D   G   D   Y   Y   C   S   S   Y   A   S   S   S   Y   T   S

....CDR3...|----Fr4------
301     AGTACCACTTGGGTGTTCGGCGGGG      (SEQ ID NO:111)
101       S   T   T   W   V   F   G   G       (SEQ ID NO:112)
```

FIG. 34B

```
Total amino acid number: 141, MW=14855
Max ORF: 1-423, 141 AA, MW=14855

T-E3-Tie1-heavy

-------------------------Fr1--------------------------
  1      GAAGTTCAATTGTTAGAGTCTGGTGGCGGTCTTGTTCAGCCTGGTGGTTCTTTACGTCTT
  1       E  V  Q  L  L  E  S  G  G  G  L  V  Q  P  G  G  S  L  R  L

--------------Fr1------------|.....CDR1.....|------Fr2------
  61     TCTTGCGCTGCTTCCGGATTCACTTTCTCTATGTACGGTATGGTTTGGGTTCGCCAAGCT
  21      S  C  A  A  S  G  F  T  F  S  M  Y  G  M  V  W  V  R  Q  A

---------------Fr2--------|...............CDR2...............
  121    CCTGGTAAAGGTTTGGAGTGGGTTTCTGTTATCTCTCCTTCTGGTGGCAATACTGGTTAT
  41      P  G  K  G  L  E  W  V  S  V  I  S  P  S  G  G  N  T  G  Y

........CDR2.....|------------------Fr3--------------------
  181    GCTGACTCCGTTAAAGGTCGCTTCACTATCTCTAGAGACAACTCTAAGAATACTCTCTAC
  61      A  D  S  V  K  G  R  F  T  I  S  R  D  N  S  K  N  T  L  Y

----------------------------Fr3------------------------|.CDR3.
  241    TTGCAGGTGAACAGCTTAAGGGCTGAGGACACTGCAGTCTACTATTGTGCGAGAGCCCCA
  81      L  Q  V  N  S  L  R  A  E  D  T  A  V  Y  Y  C  A  R  A  P

.............CDR3.........|------------Fr4----------------
  301    CGTGGATACAGCTATGGTTACTACTACTGGGGCCAGGGAACCCTGGTCACCGTCTCAAGC
  101     R  G  Y  S  Y  G  Y  Y  Y  W  G  Q  G  T  L  V  T  V  S  S

361    GCCTCCACCAAGGGCCCATCGGTCTTCCCGCTAGCACCCTCCTCCAAGAGCACCTCTGGG
  121     A  S  T  K  G  P  S  V  F  P  L  A  P  S  S  K  S  T  S  G

421    GGCAC      (SEQ ID NO:113)
  141      G        (SEQ ID NO:114)
```

FIG. 35

C1-E3_pUCrev(1-322)
Total amino acid number: 107, MW=11650

T-E3-Tie1-kappa-light
DPK4/A20+

```
                 -------------------------Fr1---------------------------
1                GACATCCAGATGACCCAGTCTCCACTCTCCCTGTCTGCATCTGTAGGAGACAGAGTCACC
1                 D   I   Q   M   T   Q   S   P   L   S   L   S   A   S   V   G   D   R   V   T

--Fr1---|...........CDR1..............|-------Fr2--------
61               ATCACTTGCCGGGCGAGTCAGGGCATTGGCCATTATTTAGCCTGGTATCAGCAGAAACCA
21                I   T   C   R   A   S   Q   G   I   G   H   Y   L   A   W   Y   Q   Q   K   P

-----------Fr2------------|.........CDR2......|----Fr3-----
121              GGGAAAGTTCCTAAGCTCCTGATCTATACTGCATCCACTTTGCAATCAGGGGTCCCATCT
41                G   K   V   P   K   L   L   I   Y   T   A   S   T   L   Q   S   G   V   P   S

---------------------------Fr3---------------------------
181              CGGTTCAGTGGCAGTGGATCTGGGACAGATTTCACTCTCACCATCAACAGCCTGCAGCCT
61                R   F   S   G   S   G   S   G   T   D   F   T   L   T   I   N   S   L   Q   P

-----------Fr3---------|..........CDR3.........|-----Fr4----
241              GAGGATGTTGCAACTTATTACTGTCAACAGTTTAATAGTTACCCTCACACCTTCGGCCAA
81                E   D   V   A   T   Y   Y   C   Q   Q   F   N   S   Y   P   H   T   F   G   Q

----------Fr4---------
301              GGGACACGACTGGATATTAAAC      (SEQ ID NO:115)
101               G   T   R   L   D   I   K   (SEQ ID NO:116)
```

FIG. 36

Table 5 Heavy Chain Sequences

| TABLE 5 | HV-CDR1 | HV-CDR2 | HV-CDR3 | From SEQ # |
|---|---|---|---|---|
| 44-A06 | SYVMM | RIYPSGGITQYADSVKG | DVYRAFDI | 164 |
| 44-A11 | SYKMH | SIYPSGGYTYYADSVKG | DSHHFHFWGDYYFLEY | 168 |
| 44-B04 | QYLMF | YIYPSGGWTMYADSVKG | QNYYDSSGYYYRGFDY | 172 |
| 44-B05 | SYKMG | SIYPSGGWTHYADSVKG | VLLHYFDY | 176 |
| 44-B08 | AYGMG | VISPSGGQTSYADSVKG | GDRYGPLHY | 180 |
| 44-B09 | NYKMN | VIYPSGGWTYYADSVKG | GYYDSSGYSRFDY | 184 |
| 44-B10 | RYKMG | SIYPSGGPTYYADSVKG | SEVGAPDY | 188 |
| 44-B12 | MYKMH | SIYPSGGYTVYADSVKG | DRWSSGGYGVDF | 192 |
| 44-C07 | HYDMS | YIYPSGGPTYYADSVKG | GDWASRFAT | 196 |
| 44-D01 | HYKMG | SIYPSGGFTRYADSVKG | NFVESSHYYHDY | 200 |
| 44-E03 | RYVMF | GIYPSGGHTRYADSVKG | RGSGGYFDY | 204 |
| 44-F03 | RYKMI | SIYPSGGTTSYADSVKG | SDLGSGWYSAEYFQH | 208 |
| 44-F06 | SYLMI | RIYPSGGGTEYADSVKG | VTYYYDSSGYQPAFDI | 212 |
| 44-F09 | HYGMT | VIGPSGGNTMYADSVKG | VWGAFDI | 216 |
| 44-G06 | SYKMG | SIYPSGGWTHYADSVKG | VLLHYFDY | 220 |
| 44-G07 | SYKMG | SIYPSGGWTHYADSVKG | VLLHYFDY | 224 |
| 44-G11 | AYPML | SISPSGGATAYADSVKG | GSYSDYGVFES | 228 |
| 44-H03 | RYRMS | GIVPSGGWTTYADSVKG | DNYYDFWSGYYISRFGMDV | 232 |
| 44-H05 | SYMMF | RIYPSGGWTYYADSVKG | VTVPLDSGSYYFDY | 236 |
| 44-H07 | SYLMT | SIYPSGGWTYYADSVKG | EMYYDFWSGYYRGFDI | 240 |
| 44-H09 | WYGMN | SISPSGGQTPYADSVKG | DLGGAYIPDS | 244 |
| 45-A02 | TYPMM | VISPSGGQTSYADSVKG | GGRLNAFDI | 248 |
| 45-A04 | IYQMG | RIYPSGGVTKYADSVKG | DFGPGDLWSGYYDAFDI | 252 |
| 45-B01 | SYQMQ | VIYPGGYTYYADSVKG | LQFYGSSAAFDI | 256 |
| 45-B03 | QYPMI | VISPSGGHTSYADSVKG | IQYYGGAFDI | 260 |
| 45-B11 | PYGML | VISPSGGQTFYADSVKG | LGAEKGMDV | 264 |
| 45-C02 | RYVMG | SIYPSGGYTYYADSVKG | DSPHCSGGSCYGGYYYYGMDV | 268 |
| 45-C11 | HYIMV | SIYPSGGVTYYADSVKG | DVAGALDY | 272 |
| 45-C12 | KYWMH | SIYSSGGRTHYADSVKG | TDSSTWYRWYFDL | 276 |
| 45-D01 | AYKMT | SIYPSGGWTWYADSVKG | DNWQGGAFDI | 280 |
| 45-D07 | RYLMM | SIYPSGGWTYYADSVKG | VAPYDSSGSVNYAFDP | 284 |
| 45-G01 | HYKMV | VIYPSGGWTRYADSVKG | EMIDTISPGWHFDL | 288 |

FIG. 37

| TABLE 5 | HV-CDR1 | HV-CDR2 | HV-CDR3 | From SEQ # |
|---|---|---|---|---|
| 45-G10 | RYQMM | SIYPSGGFTRYADSVKG | SYYYGSGTYHYSYYGMDV | 292 |
| 46-A11 | RYRMD | GIYPSGGHTYYADSVKG | LYLWGSYPTQVAFDI | 296 |
| 46-B06 | MYPML | SIYPSGGMTYYADSVKG | QGYYDSSGWTFDY | 300 |
| 46-B10 | AYVMN | GIYSSGGYIYYADSVKG | RHFNGVGFDL | 304 |
| 46-G12 | NYKMN | VIYPSGGGTYYADSVKG | VGYSSGWFLFYGMDV | 308 |
| 46-H03 | SYIMV | SIYPSGGHTPYADSVKG | QTGGYAHFDY | 312 |
| 46-H10 | SYVMH | SIYPSGGWTLYADSVKG | AVGPFDY | 316 |
| 46-H11 | RYKME | VIYPSGGHTNYADSVKG | GGYYDILTGYYKYYFDY | 320 |
| 47-B03 | SYKMS | VIYPSGGWTWYADSVKG | MMYYYDSSGYLRADAFDI | 324 |
| 47-D01 | AYKMM | SIYPSGGWTYYADSVKG | SMGYGDAFDI | 328 |
| 47-D03 | VYPMA | WISPGGKTYYADSVKG | GSRHYDKFDY | 332 |
| 47-E10 | HYKMA | VIYPSGGATYYADSVKG | ALPGGYFDY | 336 |
| 47-G09 | WYRMV | GIYPSGGFTSYADSVKG | VYYYDSSGYYFVGGFDP | 340 |
| 53-A02 | QYLMQ | SIYPSGGATYYADSVKG | RKDGYSRSAFDI | 344 |
| 53-A03 | HYVMW | GIYPSGWTVYADSVKG | DLGGTRAFDY | 348 |
| 53-A05 | NYPMT | RIYPSGGYTYYADSVKG | GRIAALDY | 352 |
| 53-A09 | RYVMH | VIYPSGGATLYADSVKG | GQYSSGWYTEGWFDP | 356 |
| 53-B09 | RYKMQ | SIYPSGGITYYADSVKG | GRGTTRAFDY | 360 |
| 53-B11 | DYAMH | RIGSSGGHTSYADSVKG | DYYYDSSGYYYPAFDI | 364 |
| 53-D03 | RYAMM | SIYPSGGSTYYADSVKG | VQGGAGAFDI | 368 |
| 53-D06 | RYKMH | SIVPSGGWTYYADSVKG | QMYYYDSSGYYVGRFDI | 372 |
| 53-D12 | SYMMF | RIYPSGGWTYYADSVKG | VTVPLDSGSYYFDY | 376 |
| 53-E03 | NYKMW | SIYPSGGWTQYADSVKG | DVGGGFDY | 380 |
| 53-E04 | HYKMG | SIYPSGGWTTYADSVKG | DSPLVVPAAIKSGAYYYGMDV | 384 |
| 53-E08 | RYVML | VIYPSGGYTYYADSVKG | GVLRAFDI | 388 |
| 53-F04 | GYGMY | VISPSGGYTHYADSVKG | AYSSGWYLDY | 392 |
| 53-F05 | SYMMF | RIYPSGGWTYYADSVKG | VTVPLDSGSYYFDY | 396 |
| 53-F06 | SYIMI | SIYPSGGQTYYADSVKG | KNGYNNVFDV | 400 |
| 53-F08 | RYPML | SIYPSGGWTSYADSVKG | PTHNWNDDPDAFDI | 404 |
| 53-G04 | KYKML | VIYPSGGYTYYADSVKG | VVVPAFYYYYMDV | 408 |
| 53-G05 | KYKMD | SIYPSGGFTYYADSVKG | EKMATMDY | 412 |
| 54-A08 | RYVMH | RIYPSGGWTYYADSVKG | VAGESNGMDV | 416 |
| 54-B06 | IYKMQ | SIYPSGGATYYADSVKG | QTYYYDSSGYFRNAFDI | 420 |

FIG. 37 Cont'd.

| TABLE 5 | HV-CDR1 | HV-CDR2 | HV-CDR3 | From SEQ # |
|---|---|---|---|---|
| 54-B08 | RYRMV | WIYPSGGWTSYADSVKG | SNYYDSAATLDI | 424 |
| 54-C03 | HYQML | SIYPSGGWTYYADSVKG | VGYSSGWYALTSKTFDY | 428 |
| 54-C07 | RYPMN | RIWPSGGSTVYADSVKG | DSSRYFDV | 432 |
| 54-E04 | NYKMH | VIYPSGGVTEYADSVKG | DQYSGHDY | 436 |
| 54-G01 | EYQMI | YIVPSGGFTAYADSVKG | VNYYGMDV | 440 |
| 54-G05 | AYLME | GIYPSGGKTYYADSVKG | VNVISVAGTGYYYYGMDV | 444 |
| 54-H10 | QYPMI | VISPSGGHTSYADSVKG | IQYYGGAFDI | 448 |
| 55-A09 | KYRMS | GIYPSGGGTTYADSVKG | PTYYYDSSGYYYSGPIDY | 452 |
| 55-B11 | AYKMH | VIYPSGGWTYYADSVKG | GTAGWFDP | 456 |
| 55-B12 | NYKMT | SIYPSGGWTYYADSVKG | QEDGGYGT | 460 |
| 55-C05 | QYKML | SIYPSGGWTSYADSVKG | ASYYDSGGYYRENFQF | 464 |
| 55-C07 | SYKMH | VIYPSGGATYYADSVKG | GLDFWSGPDY | 468 |
| 55-D03 | NYVMQ | VIYPSGGMTNYADSVKG | IRGDTRAFDI | 472 |
| 55-D06 | KYKMW | VIYPSGGATYYADSVKG | SSLGCSSTSCYDAFDI | 476 |
| 55-D12 | TYGMW | SISSGGSTVYADSVKG | DLTTVTGNYFDY | 480 |
| 55-E04 | SYKMV | SIYPSGGVTIYADSVKG | DGSSSGWYNPRRAFDY | 484 |
| 55-E06 | KYKMI | SIYPSGGHTIYADSVKG | EGGGATSFDY | 488 |
| 55-E10 | AYPMF | VISPSGGQTSYADSVKG | SFSGLAALDF | 492 |
| 55-E12 | QYTMY | SIYPSGGWTNYADSVKG | GRGGSKAFDI | 496 |
| 55-F10 | AYVMS | RIYPSGGGTRYADSVKG | EAGGSYFLDY | 500 |
| 55-G02 | SYKMI | GIYPSGGATGYADSVKG | DGGDIVVPDY | 504 |
| 55-G03 | KYHMG | SIYSSGGITQYADSVKG | GRVGGWSLFNWFDP | 508 |
| 55-H04 | SYPMY | RIVPSGGWTNYADSVKG | DKGDWYFDL | 512 |
| 56-A01 | RYAMG | WIYPSGGITSYADSVKG | ITYFDTSVIDY | 516 |
| 56-A06 | HYPME | RIVPSGGWTTYADSVKG | RVVTTYLDYFDY | 520 |
| 56-B08 | VYVMS | SIYPSGGGTYYADSVKG | RKAAAGYLDY | 524 |
| 56-B09 | HYKMS | SIYPSGGWTYYADSVKG | DRPGAFDV | 528 |
| 56-C03 | SYKMW | VIYPSGGATYYADSVKG | GIGAVGGFDS | 532 |
| 56-C04 | HYIMA | RIYPSGGKTYYADSVKG | QGGGGRAFDI | 536 |
| 56-E08 | SYIMA | GIYPSGGFTTYADSVKG | IAGGAYHLDY | 540 |
| 56-F01 | RYGME | SIYPSGGWTYYADSVKG | RGSGRYFDY | 544 |
| 56-F02 | IYVMG | SIYPSGGYTWYADSVKG | QGGGGRAFDI | 548 |
| 56-F10 | RYKMM | YIVPSGGWTYYADSVKG | VDYYDFWSGYWWSGGYGMDV | 552 |

FIG. 37 Cont'd.

| TABLE 5 | HV-CDR1 | HV-CDR2 | HV-CDR3 | From SEQ # |
|---|---|---|---|---|
| 56-F11 | RYVML | VIYPSGGYTYYADSVKG | GVLRAFDI | 556 |
| 56-G03 | KYKMH | VIYPSGGKTYYADSVKG | EMGGSGWYDY | 560 |
| 56-G04 | QYVMR | GIYPSGGWTTYADSVKG | VAAAAGAFDI | 564 |
| 56-G08 | HYGMW | VISPSGGQTNYADSVKG | GQIHGGNLAS | 568 |
| 56-G12 | NYKMN | VIYPSGGATYYADSVKG | VGYSSSWDPHFDY | 572 |
| 56-H04 | SYRMV | SIYPSGGPTRYADSVKG | WSYYYDSSGYYPVSGPFDI | 576 |
| 56-H12 | MYKMH | VIYPSGGITAYADSVKG | EVMGPSDY | 580 |
| 57-B05 | KYVMH | SIYPSGGWTYYADSVKG | STTYSSRPFDY | 584 |
| 57-H07 | RYPMM | VIYSSGYTYYADSVKG | VSRGIYYAMDV | 588 |
| 58-A09 | NYKMH | SIYPSGGPTHYADSVKG | EGYSSGWYIHWYFDL | 592 |
| 58-D04 | SYFMT | GISPSGGITSYADSVKG | GSYSDYGVFNS | 596 |
| 58-E09 | NYVMA | VIYPSGGATYYADSVKG | LAVTHFDY | 600 |
| 58-F03 | DYGMA | VISPSGGQTAYADSVKG | VRWFGAFDY | 604 |
| 58-G03 | LYLMY | VIYPSGGWTYYADSVKG | GYYYGMDV | 608 |
| 58-H01 | GYIMM | SIYPSGGHTYYADSVKG | WYYGMDV | 612 |
| 59-A02 | MYQMQ | RIYPSGGWTVYADSVKG | ITYDSSGYYDY | 616 |
| 59-A06 | PYKMI | GIYPSGGWTYYADSVKG | LLPALRGAVMDV | 620 |
| 60-B02 | IYPMH | SIYPSGGITRYADSVKG | QRGSGWHDS | 624 |
| 60-H01 | YYPMV | VIVPSGGFTAYADSVKG | KRPGNAFDI | 628 |
| 61-A03 | YYKMW | SISPGGWTHYADSVKG | GPVSSGGDY | 632 |
| 61-C05 | QYVMM | SIYPSGGQTYYADSVKG | IAGGAYHLDY | 636 |
| 61-C06 | RYVMG | RIYPSGGFTYYADSVKG | IREGYFDY | 640 |
| 61-F07 | HYVMT | SIYPSGGFTAYADSVTG | STYYYEGSGYYRAFDI | 644 |
| 61-G12 | QYKMW | VIYPSGGVTYYADSVKG | SYSPVGAFDI | 648 |
| 61-H09 | VYKMY | VIYPSGGYTDYADSVKG | QLPMSYFDY | 652 |
| 62-A12 | RYVMV | RIYPSGGFTNYADSVKG | DKTAHMDV | 656 |
| 62-B05 | RYKMN | SIYPSGGWTNYADSVKG | GGRYGDYVRH | 660 |
| 62-B07 | RYRMA | SIYPSGGVTYYADSVKG | DLSIAAAGTAY | 664 |
| 62-C08 | RYVMQ | SSIYPSGGATIYADSVKG | RGIPGYFDS | 668 |
| 62-D04 | SYGMV | SISPSGGNTGYADSVKG | GNGGFDS | 672 |
| 62-E02 | HYVMS | VIYPSGGWTGYADSVKG | GVATTSFDY | 676 |
| 62-E03 | RYLMR | GIYPSGGITAYADSVKG | ASGSYYNYYFDY | 680 |
| 62-E11 | AYVMH | RIYPSGGITYYADSVKG | GILTGPDY | 684 |

FIG. 37 Cont'd.

| TABLE 5 | HV-CDR1 | HV-CDR2 | HV-CDR3 | From SEQ # |
|---|---|---|---|---|
| 62-F10 | RYKMS | YIYPSGGHTEYADSVKG | EREGTPDY | 688 |
| 62-G06 | IYPMI | VIYPSGGHTRYADSVKG | RVYSSGSAYFDL | 692 |
| 62-H01 | MYKMA | YIYPSGGYTYYADSVKG | VRDSAFDI | 696 |
| TIE 1 E03 ref | MYGMV | VISPSGGNTGYADSVKG | APRGYSYGYYY | 114 |

FIG. 37 Cont'd.

Table 6 Light Chain Sequences

| Table 6 Clone | LV-CDR1 | LV-CDR2 | LV-CDR3 | From SEQ # |
|---|---|---|---|---|
| 44-A06 | SGSSSSIGLNPVN | SNDQRPS | AAWDDSLNGPA | 166 |
| 44-A11 | RASQSVSSSYLA | GASSRAT | QQYGSSPPGGT | 170 |
| 44-B04 | RASQSISSYLN | AASSLQS | QQSYSTPPT | 174 |
| 44-B05 | RASQSVSSYLA | DASNRAT | QQRSNWPPGIT | 178 |
| 44-B08 | RASQYISIYLN | AASSLQS | QQYKSYPLT | 182 |
| 44-B09 | QASQDISNYLN | HASNLET | LQYKSYPRL | 186 |
| 44-B10 | TGTSSDVGSYNLVS | EGSKRPS | CSYAGSSTLV | 190 |
| 44-B12 | RASQSISGWLA | KASTLKS | QQYNSYSQT | 194 |
| 44-C07 | RSSQSLLHSNGYNYLD | LGSNRAS | MQALQTPQ | 198 |
| 44-D01 | GGNNIGIKSVN | DDSGRPS | QVWDSGSDHWV | 202 |
| 44-E03 | GGSNIGGKSVH | DDRDRPS | QVWDSGTDHRV | 206 |
| 44-F03 | RGDRLRSYYSS | GRNNRPS | SSRDGSGNFL | 210 |
| 44-F06 | RASQSVGNLLA | GASSRAT | QQYGSSPPVT | 214 |
| 44-F09 | RASQSVSSYLA | DASNRAT | QQRSNWPRT | 218 |
| 44-G06 | RASQSVYNNLA | DASTTAT | QQRSNWPSLT | 222 |
| 44-G07 | RATQGIGTFLA | GASTLQS | QQPNSF | 226 |
| 44-G11 | RASQDISSWLV | DASNLQS | QQANSFPVT | 230 |
| 44-H03 | SGSSSNVGSNNVN | SNNHRPS | ATWDDNLIAPV | 234 |
| 44-H05 | TGSSSDVSGYNYVS | DVSNRPS | SSYTSSSTWV | 238 |
| 44-H07 | RASQGIRNDLG | AASSLQS | LQDYNYPWT | 242 |
| 44-H09 | RASQRVSTWVA | MASRLES | QQYNFYPRT | 246 |
| 45-A02 | RASQGISNYLA | SASTLQT | QQFNSYPRT | 250 |
| 45-A04 | QGDSLRNYHPS | GKNNRPS | NSRDSSGNHV | 254 |
| 45-B01 | TGTSSDVGGYNYVS | EVSKRPS | SSYAGSNNLI | 258 |
| 45-B03 | RASQSISRYLA | DASERAA | QQRGNWPLT | 262 |
| 45-B11 | RASQSVSSYLA | DASNRAT | QQRSNWPHT | 266 |
| 45-C02 | RASQSVSSNLA | GASSRAT | QQYGSSPRT | 270 |
| 45-C11 | TGTNRDVGGYNYVS | DVSNRPS | SSYTSSGTRV | 274 |
| 45-C12 | TGTSTDVGGYNYVS | DVSNRPS | SSYTNTITVV | 278 |
| 45-D01 | RASQSVSNWLA | KASTLES | QHYHRYSRT | 282 |
| 45-D07 | RASQSVNSNQLA | GASNRAT | QQRSNFWT | 286 |
| 45-G01 | RASQNINIYLN | TQSNLRS | QQSHSAPRT | 290 |

FIG. 38

| Table 6 Clone | LV-CDR1 | LV-CDR2 | LV-CDR3 | From SEQ # |
|---|---|---|---|---|
| 45-G10 | QGDSLRSYYAS | GKNNRPS | QSRGSSSGNHYV | 294 |
| 46-A11 | RASQSVSSTYLA | GASSRAT | QHYGSSPLT | 298 |
| 46-B06 | RASQSVSSNLA | GASTRAT | QQRSNWPLT | 302 |
| 46-B10 | RASQSVSSYLA | DASNRAT | QQRSNWPLT | 306 |
| 46-G12 | RASQSVSSSNLA | GASTRAT | QLYKT | 310 |
| 46-H03 | TGSNTDVGRYNFVS | DVYKRPS | CSYARASTFSYV | 314 |
| 46-H10 | RASQGIGTYLA | AASTLQS | QKYNSAPRP | 318 |
| 46-H11 | SGNNSNFGSNTVT | SDSRRPS | AAWDDSLNGV | 322 |
| 47-B03 | RASQRIGSYLN | GASNLES | QQTSSVSPLT | 326 |
| 47-D01 | RASQSINEWLA | AASSLQS | QQYGSSPALT | 330 |
| 47-D03 | RASQTIRSYLN | AASNLQS | QQSYSMSSWT | 334 |
| 47-E10 | TGTSSDVGGYNYVS | DVSNRPS | SSYTSTATYVLGTGTRV | 338 |
| 47-G09 | RASQSVSSSYLA | GASNRAT | MQATFWPYA | 342 |
| 53-A02 | SGNNSNFGSNTVT | SDSRRPS | AAWDDSLNGV | 346 |
| 53-A03 | RASQSVSSSYLA | GASSRAT | QQRGNWPRT | 350 |
| 53-A05 | TGTSSDDVGGYNYVS | DVSDRPS | GSYRVTSVSRSYV | 354 |
| 53-A09 | QGDTLRYFSAS | GANNRPS | NSRDGSGNWL | 358 |
| 53-B09 | SGSSSNIGSNNVN | SNDQRPS | AAWDDSLNGPV | 362 |
| 53-B11 | GGNDIGRKFVH | DDSDRPS | QVWDLSSDHWV | 366 |
| 53-D03 | RASQSVSSSYLA | GASSRAT | QQYGSSPL | 370 |
| 53-D06 | RASQSINTYLN | AASSLQS | QQSHSISTFT | 374 |
| 53-D12 | RASQSVSSYLA | DASNRAT | QQRSNWPPRIT | 378 |
| 53-E03 | RASQSVSSSYLA | GASSRAT | QQYGSSPQLT | 382 |
| 53-E04 | RASQSVSSNLA | GASTRAT | LTRVT | 386 |
| 53-E08 | SGSSYNIGVYDVY | TNNQRPS | AAWDDSLAGWV | 390 |
| 53-F04 | RASQSVSSYLA | DTSNRAT | QQRSNWPIT | 394 |
| 53-F05 | SGDNLGSRYIS | QDYRRPS | QAWDRSTAV | 398 |
| 53-F06 | RASHSVTNNRLA | GASNRAA | QQRSHWLYT | 402 |
| 53-F08 | TGTSSDVGSYNLVS | EGSKRPS | CSYAGSSTYV | 406 |
| 53-G04 | GGNNIGTKSVH | DDNDRPS | QVWDPTGDQYV | 410 |
| 53-G05 | TGTSSDVGGYNYVS | EVSNRPS | SSYTSSSTLGGV | 414 |
| 54-A08 | TGTSSDVGGCNYVS | DVSYRPS | SSCTSSSTL | 418 |

FIG. 38 Cont'd.

| Table 6 Clone | LV-CDR1 | LV-CDR2 | LV-CDR3 | From SEQ # |
|---|---|---|---|---|
| 54-B06 | RTSQSIDTYLN | GASSLES | QQSYTTSYT | 422 |
| 54-B08 | TGATRDVS | EVNSRPS | SSTTSRAPRVI | 426 |
| 54-C03 | RASQTISSYLN | AASTLQS | QQSYSTPS | 430 |
| 54-C07 | RASHNIDNFLA | DASHRAT | QQRTNWL | 434 |
| 54-E04 | RASQSISSNLA | GTSTRAT | QQYKDWPLT | 438 |
| 54-G01 | RASQSVSSYLA | DASNRAT | QQRYSWPLT | 442 |
| 54-G05 | TGTNTDVGGYNYVS | DVSNRPS | SSYTSSSTWV | 446 |
| 54-H10 | RASQSVSIYLA | DASNRAT | QQRSSWPIT | 450 |
| 55-A09 | RASQSINNHLN | AASSLQS | QQSYSTPWT | 454 |
| 55-B11 | TGTNTDVGGYNLVS | EVSNRPS | GSYTSSSTHV | 458 |
| 55-B12 | TGTSSDVGSYNLVS | EGSKRPS | CSYAGSSTYV | 462 |
| 55-C05 | QGDSLRSYYAT | GENNRPS | NSRDTSGSHLL | 466 |
| 55-C07 | RASQSISIYLN | DASSLQS | QQSYSTPPMYT | 470 |
| 55-D03 | WASQDIRTSLA | AASTLQG | QHLNGYPLT | 474 |
| 55-D06 | RASQSVSSSYLA | GASSRAT | QLFGSSPRIT | 478 |
| 55-D12 | RASQGISNYLA | AASTLQS | QKYNSAPWT | 482 |
| 55-E04 | RASQSVSSSQLA | GASSRAT | QHFGSSPPAT | 486 |
| 55-E06 | SAEKLSEKYVA | QDSRRPS | QAWFSDSLP | 490 |
| 55-E10 | RASQSVRTYLG | DASNRAT | QQRSNWPLT | 494 |
| 55-E12 | RASQTVSSGSLA | GASRRGT | QQYGSTLPLT | 498 |
| 55-F10 | TGTTSDVGGYNYVS | EVYNRPS | SSKTSSVTYV | 502 |
| 55-G02 | TGTTSDVGRYNFVS | DVTRRPS | CSYAGSFYV | 506 |
| 55-G03 | SGSSSNIGTNTVY | TNVQRPS | QSYDGSLSSAV | 510 |
| 55-H04 | RASQSVSSYLA | DASNRAT | QQRSNWPRT | 514 |
| 56-A01 | RASQSVSRYLA | DTSNRAT | QQRSNWPPALT | 518 |
| 56-A06 | TGTSSNVGNYNLVS | EDNKRPS | CSYAGSGTC | 522 |
| 56-B08 | TGTSSDIGAYKHVS | EVTNRPS | SSYTSRNTWV | 526 |
| 56-B09 | RASQSVSSSYLA | DASSRAT | QQYGRSPS | 530 |
| 56-C03 | RASQSVSSSYLA | GASSRAT | QQYNSYPIT | 534 |
| 56-C04 | RASHDISDNLN | DAFNLEA | QQFNNVPYT | 538 |
| 56-E08 | QGDSLRNYYAS | GKNNRPS | SSRDTTNYRME | 542 |
| 56-F01 | RASQSVSSYLA | DASNRAT | QQRSNWPPALT | 546 |

FIG. 38 Cont'd.

| Table 6 Clone | LV-CDR1 | LV-CDR2 | LV-CDR3 | From SEQ # |
|---|---|---|---|---|
| 56-F02 | TGTSSDVGYYNYVS | EVSNRPS | SSYAGSDNFV | 550 |
| 56-F10 | TGTSSDVGGYNYVS | DVSNRPS | SSYTSSSTLFYV | 554 |
| 56-F11 | RASQGISTYLA | ATSTLQS | QQLNSYPIT | 558 |
| 56-G03 | RASQSISSYLA | DASNRAT | QQYGSLPRT | 562 |
| 56-G04 | RASQSVSSYLA | GASSRAT | QQYGSSRHT | 566 |
| 56-G08 | RASQSISSSYLA | GTSNRAT | QQRYKWPLT | 570 |
| 56-G12 | TGTSSDVGGYNYVS | DVSNRPS | SSYTSSSTLYV | 574 |
| 56-H04 | RASQSVSSSYLA | GASSRAT | QQYKDWPRT | 578 |
| 56-H12 | RASQGVRSTYLA | GASSRAT | QQYGSSQGFT | 582 |
| 57-B05 | RSSQSLSNNLA | GASTRAT | QQANSFPRT | 586 |
| 57-H07 | RASQSIDTYLN | AASKLED | QQSYSSPGIT | 590 |
| 58-A09 | RASQSVSSSYLA | GASSRAT | QQYGRSRYT | 594 |
| 58-D04 | RASQSIDTYLN | DASNLET | QQADSFPIT | 598 |
| 58-E09 | RASQSISSSLA | DASNRAT | QQRSNWPLT | 602 |
| 58-F03 | RASQGISNYLA | GASNLQS | QQFNSYPLT | 606 |
| 58-G03 | RASQSVTSSFLS | ATSTRAT | QHYHTSPPTYT | 610 |
| 58-H01 | GGENIGSKSVH | YDNDRPS | QVWDSGSEHYV | 614 |
| 59-A02 | TGTNSDVGGYNYVS | DVTNRPS | SSYSSTSPR | 618 |
| 59-A06 | RASQSIDTYLN | AASKLED | QQSYSSPGIT | 622 |
| 60-B02 | RGDRLRSYYSS | GRNNRPS | SSRDGSGNFL | 626 |
| 60-H01 | RASQSVSSYLA | DASNRAT | QQRSNWPVT | 630 |
| 61-A03 | RASQDISRFLA | SASTLQS | QQLSRYST | 634 |
| 61-C05 | RASQSVSSYLA | DASNRAT | QQRSNWPPLT | 638 |
| 61-C06 | TGTSSDVGGYNYVS | DVTKRPS | GSYTSSGSRV | 642 |
| 61-F07 | RASQSIDTYLN | AASKLED | QQSYSSPGIT | 646 |
| 61-G12 | RASQSVSSSYLA | GASNRAT | QKYGSSSLT | 650 |
| 61-H09 | TGTSSDVGSYNRVS | DINNRPS | SSFTSSSTYI | 654 |
| 62-A12 | RSSQSLLQSNGYNYLD | LGSNRAS | MQALQTWT | 658 |
| 62-B05 | RASQSVSSYLA | DASNRAT | QQRSSWPPLT | 662 |
| 62-B07 | RASQSVSSNLA | GASIRAT | QQYKDWPRT | 666 |
| 62-C08 | RASQSFVGSRNLA | GAFNRAT | QQYGTSPRT | 670 |
| 62-D04 | RASQSISTYLN | ATSTLQS | QQFNFYPLT | 674 |

FIG. 38 Cont'd.

| Table 6 Clone | LV-CDR1 | LV-CDR2 | LV-CDR3 | From SEQ # |
|---|---|---|---|---|
| 62-E02 | TGTSSDVGSYNLVS | EGSKRPS | CSYAGSSTYV | 678 |
| 62-E03 | RASQSVSSYLA | DASNRAT | QQRSNWPRSIT | 682 |
| 62-E11 | RASQSIDTYLN | AASKLED | QQSYSSPGIT | 686 |
| 62-F10 | SLSSGHSSYAIA | KVNSDGSHTKGD | QTWGTGSWV | 690 |
| 62-G06 | TGTSSDDVGGYNYVS | DVINRPS | SSYASSGARV | 694 |
| 62-H01 | RASQSVAGLLA | KASILET | QQYSFNSGT | 698 |
| TIE 1 E03 ref | RASQGIGHYLA | TASTLQS | QQFNSYPHT | 112 |

FIG. 38 Cont'd.

Table 9

| IgG clone Name | Flexchiip Analysis hTie1-His Kd (M) Exp.1 | Flexchiip Analysis hTie1-His Kd (M) Exp.2 | Competitive GUAVA Cell binding assay E3-competed | Initial Tube formation assay | Initial Phosphorylation assay | Cell binding LEII | GUAVA cell binding assays Cell binding Tie1-LEII | GUAVA cell binding assays Cell binding HUVECs | Cell binding MS-1 cells |
|---|---|---|---|---|---|---|---|---|---|
| 59A02 | 2.36E-10 | 2.91E-10 | no | (+/-) | (+) | (+) | (+) | (+) | (+) |
| 44B08 | 3.94E-10 | 4.53E-10 | yes | (+/-) | (-) | ? | (+) | (+) | N.D. |
| 45A02* | 4.44E-10 | N.D. | no | N.D. | (-) | (-) | (-) | (-) | N.D. |
| 54G05 | 6.25E-10 | 9.85E-10 | no | (+) | (+) | (+) | (+) | N.D. | (+) |
| 53F05 | 8.60E-10 | 2.46E-10 | no | (-) | (+) | (+) | (+) | (+) | (+) |
| 53G05 | 8.66E-10 | 1.04E-09 | yes | (+) | (+) | ? | (+) | (+) | N.D. |
| 56G08 | 1.79E-09 | 1.36E-09 | yes | (+/-) | (-) | ? | (+) | (+) | N.D. |
| 45B03 | 1.92E-09 | 2.93E-09 | yes | (+/-) | (+) | (+) | (+) | (+) | (+) |
| 53F04 | 3.02E-09 | 1.07E-09 | yes | (+) | (-) | ? | (+) | (+) | (+) |
| 55E10 | 4.70E-09 | 3.23E-09 | yes | (-) | (+) | (+) | (+) | (+) | N.D. |
| 60H01 | 6.89E-09 | 5.75E-09 | yes | N.D. | (-) | (+) | (+) | N.D. | N.D. |
| 54H10 | 8.72E-09 | N.D. | yes | N.D. | (+) | (+) | (+) | (+) | N.D. |
| 58F03 | 1.17E-08 | 6.93E-09 | no | (-) | (-) | (+) | (+) | N.D. | N.D. |
| 61C06 | 1.63E-10 | 2.59E-10 | no | (-) | (-) | (+) | (+) | (+) | N.D. |
| 45B01 | 2.50E-10 | 2.18E-10 | no | (+/-) | (-) | (+) | (+) | N.D. | N.D. |
| 46G12 | 3.54E-10 | 3.90E-10 | no | (+/-) | (-) | (+) | (+) | N.D. | N.D. |
| 46H11 | 5.86E-10 | 7.56E-10 | no | (-) | (+) | (+) | (+) | (+) | N.D. |
| 53A02 | 7.37E-10 | 4.00E-10 | no | (-) | (-) | (+) | (+) | N.D. | N.D. |
| 53A05 | 8.85E-10 | 4.89E-10 | no | (-) | (-) | (+) | (+) | N.D. | N.D. |
| 46B06 | 9.31E-10 | 1.15E-09 | no | (-) | (-) | (+) | (+) | N.D. | N.D. |
| 44B10 | 9.87E-10 | 1.14E-10 | no | (-) | (-) | (+) | (+) | N.D. | N.D. |

METHOD OF INHIBITION OF VASCULAR DEVELOPMENT USING AN ANTIBODY

CROSS-REFERENCE TO RELATED APPLICATIONS

This application is a continuation-in-part of U.S. application Ser. No. 11/049,536, filed Feb. 2, 2005, which is a continuation-in-part of U.S. application Ser. No. 10/916,840, filed Aug. 12, 2004, now U.S. Pat. No. 7,348,001 which claims priority to U.S. Application Ser. No. 60/494,713, filed on Aug. 12, 2003. This application is also a continuation-in-part of PCT/US2004/026116, filed Aug. 12, 2004, which claims priority to U.S. Application Ser. No. 60/494,713, filed on Aug. 12, 2003. The contents of each of the foregoing applications are hereby incorporated by reference in their entirety.

SUBMISSIONS ON COMPACT DISC

This application incorporates by reference ASCII text file identified by the name 10280-135001.txt, containing 669KB of data, and created on Oct. 24, 2005, filed in computer-readable format (CRF) and encoded on the CD-ROM.

BACKGROUND

The oxygen and nutrients supplied by the blood vessels are crucial for tissue development and function. Indeed, the cardiovascular system is the first organ system to develop in embryos. During organogenesis and the development of tissues or tumors, the proximity of the growing cells to the circulatory system is ensured by the coordinated growth of blood vessels and organ parenchyma. It may be possible to prevent or treat diseases by modulating blood vessel development or angiogenesis.

Blood vessels are composed of an inner layer of endothelial cells and an outer layer of pericytes or smooth muscle cells. The first tubular structures are formed by endothelial cells that subsequently recruit pericytes and smooth muscle cells to ensheath them. The de novo formation of blood vessels from a dispersed population of mesodermally derived endothelial precursor cells is termed vasculogenesis. This primitive network undergoes successive morphogenetic events including sprouting, splitting, and remodeling to generate the hierarchical vascular network from large to branched small vessels. These successive morphogenetic events are collectively called angiogenesis. Previous studies have identified a number of endothelial cell specific receptor tyrosine kinases (RTKs) and their cognate ligands, which mediate the vasculogenic and angiogenic development of blood vessels. Members of the vascular endothelial growth factor (VEGF) family and their receptors function during the formation of the initial embryonic vascular plexus, whereas angiopoietins (Angs) and their receptor, Tie2, as well as ephrins and their Eph receptors are implicated in the subsequent remodeling processes. See, e.g., Jones et al. (2001) *Nat. Rev. Molec. Cell Biol.* 2:257 for a review of receptors involved in angiogenic and lymphangiogenic responses.

Tie1 and Tie2 are RTKs that are expressed almost exclusively in endothelial cells and hematopoietic precursor cells. These two receptors are required for the normal development of vascular structures during embryogenesis. The two Tie receptors form a RTK subfamily since, unlike other RTK family members, they include extracellular EGF-homology domains. See, e.g., Partanen (1992) *Mol. Cell Biol.* 12:1698 and WO 93/14124. Targeted disruption of the Tie1 gene in mice results in a lethal phenotype characterized by extensive hemorrhage and defective microvessel integrity. See, e.g., Puri et al. (1995) *EMBO J.* 14:5884. Tie2 null embryos have defects in vascular remodeling and maturation, resulting from improper recruitment of periendothelial supporting cells. Angiopoietins (Ang, e.g., Ang1, Ang2, Ang3, and Ang4) are proteins that interact with Tie2.

SUMMARY

In one aspect, the invention features a method of modulating Tie complex formation, or interactions between Tie complex components, in a subject. The method includes administering, to a subject, an agent that binds to Tie1. For example, the agent promotes Tie1 self-association (e.g., homodimerization) or antagonizes an association between at least two of the following: Tie1, Tie2, and an angiopoietin (Ang; such as Ang1, Ang2, Ang3, or Ang4). In one embodiment, the agent antagonizes formation of a heteromeric complex of Tie1, Tie2, and Ang. In another embodiment, the binding of the agent can antagonize the association between Tie1 and Tie2, between Tie1 and Ang, or between Tie2 and Ang.

In one embodiment, the agent binds to Tie1. In one embodiment, the agent antagonizes formation of a heteromeric complex of Tie1, Tie2, and Ang. In another embodiment, the binding of the agent can antagonize the association between Tie1 and Tie2, between Tie1 and Ang, or between Tie2 and Ang. In another embodiment, the agent enhances Tie1 self-association, e.g., homodimerization, and thereby associates Tie1 with Tie1 and prevents association of Tie1 with Tie2 and/or Ang. The agent can include at least two valencies for binding to Tie1. In one embodiment, the agent increases phosphorylation of Tie1, e.g., Tie1 autophosphorylation. This increase can, but need not, depend on Tie1 self-association.

In one embodiment, the agent includes a protein, such as an antibody, that binds to the extracellular domain of human Tie1. For example, the antibody can be one or more of the following: human, humanized, non-immunogenic, isolated, monoclonal, and recombinant. In one embodiment, the antibody can bind to the first Ig-like C2-type domain (Ig 1) or to the second Ig-like C2-type domain (Ig 2) of Tie1. In one embodiment, the antibody binds to an EGF-like domain of Tie1 (e.g., first, second, or third EGF-like domain). In one embodiment, the antibody binds to the fibronectin type III repeats region of Tie1. In one embodiment, the antibody binds to amino acid residues 24-124, 74-174, 124-224, 174-274, 224-324, 274-374, 324-424, 374-474, 424-524, 474-574, 524-624, 574-674, 624-724, 674-759, or 724-759 of SEQ ID NO:2.

In one embodiment, the agent includes a protein that binds to a Tie1 ectodomain and includes a heavy chain (HC) immunoglobulin variable domain sequence and a light chain (LC) immunoglobulin variable domain sequence. The protein can further include one or more of the following properties: (1) at least one of the variable domain sequences includes at least one CDR of the E3 or E3b antibody (e.g., one, two, or three CDRs of the E3 or E3b antibody); (2) at least one of the variable domain sequences includes CDR sequences at least 85% identical, in sum, to the CDRs of the corresponding variable domain of the E3 or E3b antibody, (3) at least one of the variable domains is at least 85% identical to the corresponding immunoglobulin variable domains of the E3 or E3b antibody, and (4) the protein competes with E3 or E3b for binding to Tie1 or binds to an epitope that overlaps the epitope bound by E3 or E3b on Tie1. Example of antibodies that include an antigen binding site that competes with E3 for binding to Tie1 include M0044B08, M0056G08, M0045B03, M0053F04, M0055E10, M0060H01, M0054H10, M0058F03, and related antibodies.

In one embodiment, the agent includes the HC and/or LC variable domain of the E3 or E3b antibody, or a sequence at least 70, 80, 85, 90, 95, 98, 99% identical to the HC and/or LC variable domains of the E3 or E3b antibody. In one embodiment, the amino acid sequences of the HC variable domain sequence include CDR1, CDR2, and CDR3 sequences from the E3 or E3b clone and the LC variable domain sequence includes CDR1, CDR2, and CDR3 sequences from the E3 or E3b clone. In one embodiment, the agent comprises the E3 or E3b antibody. The LC variable domain sequence can include SEQ ID NO:116. The HC variable domain sequence can include SEQ ID NO:114. In one embodiment, the HC and LC framework regions are human. In one embodiment, that agent includes SEQ ID NO:723 and SEQ ID NO:724.

In one embodiment, the agent binds to Tie2. In one embodiment, the agent antagonizes formation of a heteromeric complex of Tie1, Tie2, and Ang. In another embodiment, the binding of the agent can antagonize the association between Tie1 and Tie2, between Tie1 and Ang, or between Tie2 and Ang. In another embodiment, the agent enhances Tie2 self-association, e.g., homodimerization, and, thereby associates Tie2 with Tie2 and prevents association of Tie2 with Tie1 and/or Ang. In one embodiment, the agent includes a protein, e.g., an antibody that binds to the extracellular domain of human Tie2. For example, the antibody can be one or more of the following: human, humanized, non-immunogenic, isolated, monoclonal, and recombinant. In one embodiment, the antibody can bind to the first Ig-like C2-type domain (Ig 1) or to the second Ig-like C2-type domain (Ig 2) of Tie2. In one embodiment, the antibody binds to an EGF-like domain of Tie2 (e.g., first, second, or third EGF-like domain). In one embodiment, the antibody binds to the fibronectin type III repeats region of Tie2. In one embodiment, the antibody binds to amino acid residues 19-119, 69-169, 119-229, 169-269, 229-329, 269-369, 329-429, 369-469, 429-529, 469-569, 529-629, 569-669, 629-729, 669-745, 729-745 of SEQ ID NO:162.

In one embodiment, the agent binds to Ang (e.g., Ang1, Ang2, Ang3, or Ang4). In one embodiment, the agent antagonizes formation of a heteromeric complex of Tie1, Tie2, and Ang. In another embodiment, the binding of the agent can antagonize the association between Tie1 and Tie2, between Tie1 and Ang, or between Tie2 and Ang. In one embodiment, the agent includes a protein, e.g., an antibody that binds to Ang. For example, the antibody can be one or more of the following: human, humanized, non-immunogenic, isolated, monoclonal, and recombinant. In one embodiment, the antibody binds to the N-terminal domain of Ang1 (e.g., the N-terminal 50 amino acids of Ang1). In one embodiment, the antibody binds to the coiled-coil domain of Ang1. In one embodiment, the antibody binds to the fibrinogen-like domain of Ang1. In one embodiment, the antibody binds to amino acid residues 1-100, 50-150, 100-200, 150-250, 200-300, 250-350, 300-400, 350-450, 400-497, or 450-497 of SEQ ID NO:163.

In one embodiment, the agent includes a protein that contains a heavy chain (HC) immunoglobulin variable domain sequence and a light chain (LC) immunoglobulin variable domain sequence. In one embodiment, the HC and LC framework regions are human. In one embodiment, the agent also includes an Fc domain. In one embodiment, the agent includes the constant domains of a human IgG1, IgG2, IgG3, or IgG4. In one embodiment, the constant domains of the heavy chain are f allotype, (a,z) allotype, or any other allotype.

In one embodiment, the agent is administered in an amount effective to decrease vascular development or angiogenesis. In one embodiment, the subject has an angiogenesis-related disorder. In other embodiments, the subject has for example: a neoplastic disorder, metastatic cancer, an angiogenesis-dependent cancer or tumor, an inflammatory disorder, rheumatoid arthritis, or psoriasis. In one embodiment, the protein is delivered systemically.

In another embodiment, the protein is administered in an amount effective to reduce one or more of the following activities: sprouting, splitting, remodeling of blood vessels, vasculogenesis, and tubule formation. The method can include other features described herein.

In one aspect, the invention includes a method of decreasing or inhibiting endothelial cell activity in the subject, the method includes administering an agent that decreases or inhibits Tie complex formation in an amount effective to decrease or inhibit endothelial cell activity in the subject. The method can include other features described herein.

In one aspect, the invention includes a method of decreasing endothelial cell activity by administering an agent that causes Tie1 phosphorylation. In one embodiment, the phosphorylation decreases endothelial cell differentiation, e.g., sprouting, splitting, and tube formation.

In another aspect, the invention includes a method of decreasing endothelial cell activity, the method by administering an agent that activates a signaling pathway. In one embodiment, the signaling pathway decreases endothelial cell differentiation, e.g., sprouting, splitting, and tube formation. For example, the agent increases Tie1 autophosphorylation. The method can include other features described herein.

In one aspect, the invention includes an antibody for modulating Tie complex formation in a subject, wherein the antibody antagonizes an association between at least two of the following: Tie1, Tie2, and an angiopoietin (Ang). In one embodiment, the antibody binds to a Tie complex component or to one or more of Tie1, Tie2, and an Ang. In one embodiment, the antibody antagonizes formation of a heteromeric complex of Tie1, Tie2, and Ang. In another embodiment, the antibody can antagonize the association between Tie1 and Tie2, between Tie1 and Ang, or between Tie2 and Ang.

In one embodiment, the antibody binds to Tie1. In one embodiment, the antibody antagonizes formation of a heteromeric complex of Tie1, Tie2, and Ang. In another embodiment, the binding of the antibody can antagonize the association between Tie1 and Tie2, between Tie1 and Ang, or between Tie2 and Ang. In another embodiment, the antibody enhances Tie1 self-association, e.g., homodimerization, and thereby associates Tie1 with Tie1 and prevents association of Tie1 with Tie2 or Ang. In another embodiment, the antibody increases Tie1 phosphorylation and/or prevents association of Tie 1 with Tie2 or Ang. In one embodiment, the antibody includes an antibody that binds to the extracellular domain of human Tie1. For example, the antibody can be one or more of the following: human, humanized, non-immunogenic, isolated, monoclonal, and recombinant. In one embodiment, the antibody can bind to the first Ig-like C2-type domain (Ig 1) or to the second Ig-like C2-type domain (Ig 2) of Tie1. In one embodiment, the antibody binds to an EGF-like domain of Tie1 (e.g., first, second, or third EGF-like domain). In one embodiment, the antibody binds to the fibronectin type III repeats region of Tie1. In one embodiment, the antibody binds to amino acid residues 24-124, 74-174, 124-274, 174-274, 224-324, 274-374, 324-424, 374-474, 424-524, 474-574, 524-624, 574-674, 624-724, 674-759, or 724-759 of SEQ ID NO:2.

In one embodiment, the antibody binds to a Tie1 ectodomain and includes a heavy chain (HC) immunoglobulin variable domain sequence and a light chain (LC) immunoglobulin variable domain sequence, the protein further includes one or more of the following properties: (1) at least one of the variable domain sequences includes at least one CDR of the E3 or E3b antibody; (2) at least one of the variable domain sequences includes CDR sequences at least 85% identical, in sum, to the CDRs of the corresponding variable domain of the E3 or E3b antibody; (3) at least one of the variable domains is at least 85% identical to the corresponding immunoglobulin variable domains of the E3 or E3b antibody, and (4) the protein competes with E3 or E3b for binding to Tie1 or binds to an epitope that overlaps the epitope bound by E3 or E3b on Tie1. For example, the antibody is at least bivalent, e.g., with at least two antigen binding sites that bind to Tie1. In one embodiment, the antibody comprises the E3, E3b (e.g., DX-2220), or DX-2240.

In one embodiment, the antibody includes one or more variable domains from the E3 or E3b antibody or a variable domain sequence that is at least 70, 75, 80, 85, 90, 95, 98, or 995 identical to such a variable domain. In one embodiment, the amino acid sequences of the HC variable domain sequence include CDR1, CDR2, and CDR3 sequences from the E3 or E3b clone, and the LC variable domain sequence includes CDR1, CDR2, and CDR3 sequences from the E3 or E3b clone. In one embodiment, the LC variable domain sequence includes SEQ ID NO:116. In one embodiment, the HC variable domain sequence includes SEQ ID NO:114. In one embodiment, the HC and LC framework regions are human.

In one embodiment, the antibody binds to Tie2. In one embodiment, the antibody antagonizes formation of a heteromeric complex of Tie1, Tie2, and Ang. In another embodiment, the binding of the antibody can antagonize the association between Tie1 and Tie2, between Tie1 and Ang, or between Tie2 and Ang. In another embodiment, the antibody enhances Tie2 self-association, e.g., homodimerization, and thereby associates Tie2 with Tie2 and prevents association of Tie2 with Tie1 or Ang. In one embodiment, the antibody causes Tie1 phosphorylation. In one embodiment, the antibody prevents association of Tie1 with Tie2 or Ang. In one embodiment, the antibody includes an antibody that binds to the extracellular domain of human Tie2. The antibody may have one or more of these properties, e.g., the antibody may cause Tie1 phosphorylation and prevent association of Tie1 with Tie2 or Ang, etc.

For example, the antibody can be one or more of the following: human, humanized, non-immunogenic, isolated, monoclonal, and recombinant. In one embodiment, the antibody can bind to the first Ig-like C2-type domain (Ig 1) or to the second Ig-like C2-type domain (Ig 2) of Tie2. In one embodiment, the antibody binds to an EGF-like domain of Tie2 (e.g., first, second, or third EGF-like domain). In one embodiment, the antibody binds to the fibronectin type III repeats region of Tie2. In one embodiment, the antibody binds to amino acid residues 19-119, 69-169, 119-229, 169-269, 229-329, 269-369, 329-429, 369-469, 429-529, 469-569, 529-629, 569-669, 629-729, 669-745, 729-745 of SEQ ID NO:162.

In one embodiment, the antibody binds to Ang. In one embodiment, the antibody antagonizes formation of a heteromeric complex of Tie1, Tie2, and Ang. In another embodiment, the binding of the antibody can antagonize the association between Tie1 and Tie2, between Tie1 and Ang, or between Tie2 and Ang. For example, the antibody can be one or more of the following: human, humanized, non-immunogenic, isolated, monoclonal, and recombinant. In one embodiment, the antibody binds to the N-terminal domain of Ang1 (i.e., the N-terminal 50 amino acids of Ang1). In one embodiment, the antibody binds to the coiled-coil domain of Ang1. In one embodiment, the antibody binds to the fibrinogen-like domain of Ang1. In one embodiment, the antibody binds to amino acid residues 1-100, 50-150, 100-200, 150-250, 200-300, 250-350, 300-400, 350-450, 400-497, or 450-497 of SEQ ID NO:163.

In one embodiment, the antibody includes a heavy chain (HC) immunoglobulin variable domain sequence and a light chain (LC) immunoglobulin variable domain sequence.

In one embodiment, the HC and LC framework regions are human. In one embodiment, the antibody also includes an Fc domain. In one embodiment, the antibody includes the constant domains of a human IgG1, IgG2, IgG3, or IgG4.

In one embodiment, the antibody is administered in an amount effective to decrease vascular development and angiogenesis. In one embodiment, the antibody is delivered systemically. In one embodiment, antibody is administered in an amount effective to reduce one or more of the following activities: sprouting, splitting, remodeling of blood vessels, vasculogenesis, and tubule formation.

In one aspect, the invention includes an isolated protein that includes one or more variable domains of an antibody described herein.

In one aspect, the invention includes a nucleic acid that includes a coding sequence that encodes a polypeptide that includes a variable domain of an antibody described herein.

In one aspect, the invention includes a pharmaceutical composition that includes an antibody described herein. The composition and antibody can include other features described herein.

In one aspect, the invention includes an antibody described herein for treatment of an angiogenesis-related disorder. The antibody and treatment can include other features described herein.

In one aspect, the invention includes an antibody described herein for the manufacture of a medicament for treating an angiogenesis-related disorder. The medicament and antibody can include other features described herein.

In one aspect, the invention includes a method of providing a first therapy that includes administering a first agent in combination with a second therapy, e.g., an anti-cancer therapy. The first agent is an agent that decreases Tie complex formation or an agent that increases Tie1 homodimerization. For example, the first agent is a Tie1 binding protein. In one embodiment, the second therapy includes radiation therapy or surgery. In one embodiment, the second therapy includes administering a second agent. For example, the second agent antagonizes or decreases Tie complex formation or increases Tie1 homodimerization. In one embodiment, the second agent is an agent that antagonizes signaling through a VEGF pathway, e.g., a VEGF antagonist antibody, e.g., bevacizumab; VEGF-Receptor tyrosine kinase inhibitor, or another agent that antagonizes VEGF pathway signalling. See also "Combination Therapies" below.

In another aspect, the invention includes a composition that includes an agent that decreases Tie complex formation and an anti-cancer agent. For example, the anti-cancer agent can be a second agent that antagonizes Tie complex formation or a second agent that antagonizes a VEGF pathway.

In one aspect, the invention features an antibody that decreases endothelial cell activity by causing Tie1 phosphorylation. For example, the antibody may decrease endothelial cell differentiation, e.g., sprouting, splitting, and tube formation.

In one aspect, the invention features a protein (e.g., an isolated protein) that includes a heavy chain immunoglobulin variable domain sequence and a light chain immunoglobulin variable domain sequence and binds to Tie1 ectodomain. The binding protein binds to Tie1 ectodomain. For example, the protein binds with an affinity $K_D$ of less than $10^{-8}$ M, $5 \cdot 10^{-9}$ M, $10^{-9}$ M, $10^{-10}$ M, $10^{-11}$ M, or $10^{-12}$ M.

In one embodiment, one or more of the CDRs of the heavy and/or light chain variable domain sequence are human, primate, non-rodent (e.g., non-mouse or non-rat), or synthetic. In one embodiment, one or more of the framework regions of the heavy and/or light chain variable domain sequence are human, primate, or non-rodent (e.g., non-mouse or non-rat).

In one embodiment, the heavy chain variable domain sequence includes one or more of the following properties:
 i) a HC CDR1 that includes an amino acid sequence as follows:
  (AGSR)-Y-(GVK)-M-(GSVF), (SEQ ID NO:117)
  (AGSIMRH)-Y-(GVMK)-M-(GSVMFH) (SEQ ID NO:118), or
  (AGSIMRNH)-Y-(AGTVMKPQ)-M-(AGSTVMYW-FKH) (SEQ ID NO:119);
 ii) a HC CDR2 that includes an amino acid sequence as follows:
  X-I-Y-P-S-G-G-X-T-X-Y-A-D-S-V-K-G (SEQ ID NO:120), wherein X is any amino acid,
  (GSV)-I-(SY)-P-S-G-G-(WQ)-T-(GY) (SEQ ID NO:121),
  (GSV)-I-(SY)-P-S-G-G-(WNQ)-T-(GY) (SEQ ID NO:160)
  (GSV)-I-(SY)-P-S-G-G-(WQ)-T-(GY)-Y-A-D-S-V-K-G (SEQ ID NO:122),
  (GSVW)-I-(SY)-P-S-G-G-(AGVMYWPQH)-T-(AG-STLVMYFKH)
  (SEQ ID NO:123), or
  X-I-Y-P-S-G-G-(WPS)-T-(YVH)-Y-A-D (SEQ ID NO: 722), wherein X is any amino acid;
 iii) a HC CDR3 that includes an amino acid sequence as follows:
  V-(four or five residues)-F-D-(I/Y) (SEQ ID NO:124),
  G-Y-G-P-I-A-P-G-L-D-Y (SEQ ID NO:125),
  (GV)-N-Y-Y-(GYD)-S-(SD)-G-Y-G-P-I-A-P-G-L-D-Y (SEQ ID NO:126),
  (GVD)-(AGLN)-(LYR)-(GSTLYH)-(GYD)-(AGSYFP)-(SFD)-(AGYD)-(IY)-(GFD)-(YDP)-(IP)-A-P-G-L-D-Y (SEQ ID NO:127),
  A-P-R-G-Y-S-Y-G-Y-Y-Y (SEQ ID NO:157),
  VNYYDSSGYGPIAPGLDY (SEQ ID NO:128), or
  G-X-X-G-(AY)-F-D-(YI) (SEQ ID NO:705), wherein X is any amino acid.

In one embodiment, the light chain variable domain sequence includes one or more of the following properties:
 i) a LC CDR1 that includes an amino acid sequence as follows:
  R-A-S-Q-S-(IV)-S-(SR)-X1-Y-L-(AN) (SEQ ID NO:129),
  R-A-S-Q-S-(IV)-S-S-(YS)-L-(ALN) (SEQ ID NO:706),
  T-G-T-(SN)-S-D-V-G-(GS)-Y (SEQ ID NO:707),
  (SGQ)-(GS)-(DS)-(NS)-(IL)-(GR)-S-(YKN)-(YS)-(VA) (SEQ ID NO:708),
  R-A-S-Q-S-V-S-S-X-L (SEQ ID NO:130),
  R-A-S-Q-S-(IV)-S-(SR)-(SY)-(LY)-(ALN) (SEQ ID NO:131), or
  R-A-S-(REQ)-(GSTRN)-(IV)-(GSTIRN)-(STIRH)-X1-(SYWNH)-(LV)-(ASN) (SEQ ID NO:132), wherein X1 can be serine or absent;
 ii) a LC CDR2 that includes an amino acid sequence as follows:
  X-A-S-X-R-A-T (SEQ ID NO:133), wherein X can be any amino acid,
  (AGD)-A-S-(STN)-R-A-T (SEQ ID NO:134),
  (DG)-(AV)-S-N-(RL)-(AP)-ST) (SEQ ID NO:709),
  (AGD)-A-S-(STN)-(LR)-(AEQ)-(ST) (SEQ ID NO:135), or
  (AGTKDEH)-A-S-(STN)-(LR)-(AVEQ)-(ST) (SEQ ID NO:136); and
 iii) a LC CDR3 that includes an amino acid sequence as follows:
  Q-Q-(SYFR)-(GSYN)-S-(STYW)-(RP)-(LWRH)-(TIY) (SEQ ID NO:161),
  Q-Q-(SYFR)-(GSYN)-S-(STYW)-(RP)-(LWR)-(TIY)-T (SEQ ID NO:137),
  (LQ)-Q-(SYFR)-(GSYN)-(SKN)-(STYW)-(RP)-(LWR)-(TIY)-T (SEQ ID NO:138),
  Q-Q-X-S-(SN)-(WS)-P-X-T-F (SEQ ID NO:710), wherein X is any amino acid,
  Y-(TG)-(SG)-S-(PGS)-(TN)-X-(VT) (SEQ ID NO:711), wherein X is any amino acid,
  Q-Q-(YR)-(GS)-S-(SW)-P-R-X1-T (SEQ ID NO:139), wherein X1 is any amino acid or absent,
  Q-Q-F-N-S-Y-P-H (SEQ ID NO:158),
  (LQ)-(LQ)-(SYFRD)-(GSYN)-(STRKN)-(STYWF)-(RP)-(ILMWRH)-(TIY)-(TI) (SEQ ID NO:140), or
  (LQ)-(LRQ)-(SYFRD)-(GSYN)-(ASTRKN)-(STYWF)-(SVRP)-(STILMWRH)-(TIY)-(STI) (SEQ ID NO:141).

In one embodiment, the light chain variable domain sequence includes one or more of the following properties:
 i) a LC CDR1 that includes an amino acid sequence as follows:
  S-X-(ND)-(IV)-(AG)-X1-X2-X3 (SEQ ID NO:142), or
  T-(GR)-(ST)-S-X5-(ND)-(IV)-(AG)-X1-X2-X3-Y-X4-S (SEQ ID NO:143), wherein X1 is any amino acid (e.g., G or R), X2 is any amino acid (e.g., Y or N), X3 is any amino acid (e.g., F, N, or K), X4 is any amino acid (e.g., aliphatic, e.g., V or A);
 ii) a LC CDR2 that includes an amino acid sequence as follows:
  (DE)-V-N-N-R-P-S (SEQ ID NO:144)
  (DE)-(VD)-(STDN)-(YRDN)-R-P-S (SEQ ID NO:145);
 iii) a LC CDR3 that includes an amino acid sequence as follows:
  (SQ)-S-(SY)-(ASID)-(GSR)-(ST)-(STRN)-(STYR)-(ATLY)-(SWIQ) (SEQ ID NO:146).

In one embodiment, the HC CDR2 includes an amino acid sequence as follows: (GSVW)-I-(SY)-P-SG-G-(AGVMYW-PQH)-T-(AGSTLVMYFKH)-Y-(AT)-D-S-V-K-G (SEQ ID NO:147) or (GSV)-I-(SY)-P-SG-G-(WQ)-T-(GY)-Y-(AT)-D-S-V-K-G (SEQ ID NO:148).

In one embodiment, the protein includes HC CDR1 and HC CDR2 sequences that are related to the corresponding CDR sequences of p-F3, E3 or E3b. For example, the protein includes the sequence MYGM (SEQ ID NO:149), at a position corresponding to HC CDR1. The sequence can be followed by a small amino acid, e.g., glycine, alanine, valine, or serine. In another example, the protein the sequence VISPSGGX$_1$TX$_2$YADSAVKG (SEQ ID NO:150), at a position corresponding to HC CDR2. For example, X$_1$ can be a hydrophilic amino acid, e.g., glutamine or asparagine. For example, X$_2$ can be a small amino acid, e.g., glycine, alanine, valine, or serine.

In one embodiment, the heavy chain variable domain sequence can have one or more of the following features: the amino acid residue at Kabat position 31 is A, H, K, N, Q, R, S, or T, e.g., H, N, R, or S; the amino acid residue at Kabat position 32 is Y; the amino acid residue at Kabat position 33 is G, K, P, R, or V, e.g., K or V; the amino acid residue at Kabat position 34 is M; the amino acid residue at Kabat position 35 is A, G, H, I, L, M, S, or V, e.g., G, H, M, or V; the amino acid residue at Kabat position 50 is G, R, S, or V, e.g., S or V; the amino acid residue at Kabat position 51 is I; the amino acid residue at Kabat position 52 is S or Y, e.g., Y; the amino acid residue at Kabat position 52a is P or S, e.g., P; the amino acid residue at Kabat position 53 is S; the amino acid residue at Kabat position 54 is G; the amino acid residue at Kabat position 55 is G; the amino acid residue at Kabat position 56 is A, F, H, I, Q, W, or Y, e.g., A, W or Y; the amino acid residue at Kabat position 57 is T; the amino acid residue at Kabat position 58 is R, S, T, or Y, e.g., Y. In one embodiment, the length of CDR3 is between 8-18 amino acids, e.g., between 8-12, 8-10, or 15-17 amino acids.

In one embodiment, two or three of the CDRs of the HC variable domain sequence match motifs that also match a HC variable domain of an antibody described herein. Similarly, in one embodiment, two or three of the CDRs of the LC variable domain sequence match motifs that also match a LC variable domain of an antibody described herein. In still another embodiment, the matched motifs for the CDRs are based on a HC and a LC that are paired in an antibody described herein.

In one embodiment, the H1 and H2 hypervariable loops have the same canonical structure as an antibody described herein. In one embodiment, the L1 and L2 hypervariable loops have the same canonical structure as an antibody described herein.

In one embodiment, the HC CDR1 amino acid sequences have a length of at least 5 amino acids of which at least 3, 4, or 5 amino acids are identical to the CDR1 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the HC CDR2 amino acid sequences have a length of at least 15, 16, or 17 amino acids of which at least 10, 12, 14, 15, 16, or 17 amino acids are identical to the CDR2 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the HC CDR2 amino acid sequences have a length of at least 17 amino acids of which at least 14, 15, 16, or 17 amino acids are identical to the CDR2 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the HC CDR3 amino acid sequences have a length of at least of at least 7 or 8 amino acids of which at least 5, 6, 7, or 8 amino acids are identical to the CDR3 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, two or three of the CDRs of the HC variable domain sequence match motifs described herein such that the motifs are a set of motifs that match a HC variable domain of a clone described herein, e.g., E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. For example, the protein may include SEQ ID NO:118 and SEQ ID NO:160, e.g., motifs that match the E3 HC variable domain.

In one embodiment, the LC CDR1 amino acid sequences have a length of at least 10, 11, or 12 amino acids of which at least 7, 8, 9, 10, or 11 amino acids are identical to the CDR1 sequence of the LC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the LC CDR2 amino acid sequences have a length of at least 6 or 7 amino acids of which at least 5, 6, or 7 amino acids are identical to the CDR2 sequence of the LC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the LC CDR3 amino acid sequences have a length of at least of at least 8, 9, or 10 amino acids of which at least 7, 8, 9, or 10 amino acids are identical to the CDR3 sequence of the LC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, two or three of the CDRs of the LC variable domain sequence match motifs described herein such that the motifs are a set of motifs that match a LC variable domain of a clone described herein, e.g., E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. For example, the protein may include SEQ ID NO:132, SEQ ID NO:136, and SEQ ID NO:161, e.g., motifs that match the E3 LC variable domain.

In one embodiment, the amino acid sequence of the HC variable domain sequence is at least 70, 80, 85, 90, 92, 95, 97, 98, 99, or 100% identical to the amino acid sequence of the HC variable domain of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the amino acid sequence of the LC variable domain sequence is at least 70, 80, 85, 90, 92, 95, 97, 98, 99, or 100% identical to the amino acid sequence of the LC variable domain of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the amino acid sequences of the HC and LC variable domain sequences are at least 70, 80, 85, 90, 92, 95, 97, 98, 99, or 100% identical to the amino acid sequences of the HC and LC variable domains of a clone selected from the group consisting of E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, and any other antibody described herein.

In one embodiment, the amino acid sequences of one or more framework regions (e.g., FR1, FR2, FR3, and/or FR4) of the HC and/or LC variable domain are at least 70, 80, 85, 90, 92, 95, 97, 98, 99, or 100% identical to corresponding framework regions of the HC and LC variable domains of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the amino acid sequences of the HC and LC variable domain sequences comprise a sequence encoded by a nucleic acid that hybridizes (e.g., under high stringency) to a nucleic acid encoding a variable domain of E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the light chain variable domain sequence is human or non-immunogenic in a human. In one embodiment, the heavy chain variable domain sequence is human or non-immunogenic in a human.

The protein can bind to cells that express Tie1, e.g., endothelial cells. In one embodiment, the protein does not substantially bind (e.g., does not detectably bind) to platelets (e.g., resting and/or activated platelets).

In one embodiment, the protein inhibits tube formation by HUVECs in vitro. For example, the E3 antibody inhibits tube formation by HUVECs in vitro (e.g., under conditions described in Example 18). In one embodiment, the protein inhibits angiogenesis in an in vivo MATRIGEL™ plug assay. For example, the E3 antibody can inhibit angiogenesis in an exemplary assay (see, e.g., an exemplary assay described in Example 21).

In one embodiment, the protein recognizes melanoma-associated structures in a histological section, e.g., not only melanoma tissue, but antigen in surrounding structures. In one embodiment, the protein does not stain blood vessels in normal skin in a histological section.

In one embodiment, the protein specifically binds to Tie1, e.g., it binds with at least a 10, 50, 100, $10^3$, or $10^4$ fold preference for Tie1 relative to another human protein, e.g., Tie2, a natural protein other than Tie1 that has a Ig-like domain, an EGF-like domain, or fibronectin Type III repeat, or human serum albumin. In one embodiment, the protein binds to a domain of Tie1 described herein.

In another aspect, the invention features a protein (e.g., an isolated protein) that modulates activity of Tie1, e.g., the Tie1 receptor. For example, the protein is not naturally occurring. In one embodiment, the protein includes a HC and LC immunoglobulin variable domain sequence. In one embodiment, one or more of the CDRs of the heavy and/or light chain variable domain sequence are human, primate, non-rodent (e.g., non-mouse or non-rat), or synthetic. In one embodiment, one or more of the framework regions of the heavy and/or light chain variable domain sequence are human, primate, or non-rodent (e.g., non-mouse or non-rat). In another embodiment, the protein is substantially free of an immunoglobulin variable domain, e.g., the protein includes a peptide that independently interacts with Tie1 or a polypeptide that does not include a immunoglobulin variable domain.

In one embodiment, the protein activates an activity of the Tie1 protein, e.g., an activity in the Tie1/EpoR chimeric BaF3 cell assay described in Example 2. A protein that activates in this assay can behave as antagonists in other conditions, for example, in vivo.

In one embodiment, the protein includes the HC and LC immunoglobulin variable domains of the E3, E3b, or other antibody, HC and/or LC immunoglobulin variable domain sequences that are at least 70, 80, 85, 90, 91, 92, 93, 94, 95, 96, 97, 98, 99, or 100% identical in the CDR regions to the respective CDRs of the E3, E3b or other antibody described herein. In one embodiment, the protein competes with E3, E3b, or other antibody described herein for binding to Tie1 or binds to an epitope that overlaps an epitope that is recognized by E3, E3b, or other antibody described herein, or that has at least one, two or three residues in common with an epitope that is recognized by E3, E3b, or other antibody described herein.

In one embodiment, the activating protein enables IL-3 dependent cells that express a chimeric receptor including the Tie1 extracellular domain and the EpoR intracellular domain to survive in the absence of IL-3.

In one embodiment, the protein can cause dimerization of Tie1. In one embodiment, the protein can cause auto-phosphorylation of the RTK domain of Tie1.

In one embodiment, the protein synergizes with the E3 or E3b antibody to activate an activity of Tie, e.g., in the Tie1/EpoR chimeric BaF3 cell assay. In one embodiment, the protein includes the HC and LC immunoglobulin variable domains of the G2 or C7 antibody or domains that are at least 70, 80, 85, 90, 91, 92, 93, 94, 95, 96, 97, 98, 99, or 100% identical in the CDR regions. In one embodiment, the protein competes with G2 or C7 for binding to Tie1 or binds to an epitope that overlaps an epitope that is recognized by G2 or C7 or that has at least one, two or three residues in common with an epitope that is recognized by G2 or C7.

In another embodiment, the protein antagonizes an activity of the Tie1 protein. For example, the protein can at least partially inhibit the ability of the E3 or E3b antibody to agonize the Tie protein. In one embodiment, the protein can at least partially inhibit the ability of the E3 or E3b antibody to enable IL-3 dependent cells that express a chimeric receptor including the Tie1 extracellular domain and the EpoR intracellular domain to survive in the absence of IL-3.

In one embodiment, the HC and LC immunoglobulin variable domain sequences of the protein include the amino acid sequences that are at least 70, 80, 85, 90, 91, 92, 93, 94, 95, 96, 97, 98, 99, or 100% identical to the amino acid sequences of respective immunoglobulin variable domains of B2 or D11.

In one embodiment, the Tie1 binding protein includes the HC and LC immunoglobulin variable domains of an antibody selected from the group consisting of: B2, D11, A2, A10, P-B1, P-B3, and P-C6 or immunoglobulin domains that are at least 70, 80, 85, 90, 91, 92, 93, 94, 95, 96, 97, 98, 99, or 100% identical in the CDR regions to the CDR regions of the respective antibodies. For example, the protein binds with an affinity $K_D$ of less than $10^{-8}$ M, $5 \cdot 10^{-9}$ M, $10^{-9}$ M, $10^{-10}$ M, $10^{-11}$ M, or $10^{-12}$ M.

In one embodiment, the protein can at least partially inhibit the ability of a naturally occurring Tie1 binding protein from interacting with the Tie protein.

The protein can include other features described herein.

In another aspect, the invention features an antibody (e.g., an isolated antibody) that binds to the Tie1 ectodomain, but does not substantially bind to platelets, e.g., as detected by fluorescence activated cell sorting. For example, the antibody does not substantially bind to activated platelets and/or resting platelets. In one embodiment, the antibody binds to endothelial cells. In one embodiment, the protein is a monoclonal antibody. The antibody can be provided in a preparation that is free of other Tie1-binding antibodies that have other specificities, e.g., free of Tie1 binding antibodies that bind to platelets. The antibody can include other features described herein.

In another aspect, the invention features a protein (e.g., an isolated protein) that preferentially binds to a Tie1 protein in a conformation stabilized by the E3 or E3b antibody relative to an endogenous Tie1 protein in an unstimulated state. In one embodiment, the protein includes immunoglobulin HC and LC domains. In another embodiment, the protein includes a peptide (e.g., of length less than 30, 28, 25, 22, 20, 18, 16, or 14 amino acids) that independently binds to Tie1. For example, the peptide can include one, two, or three disulfide bonds. The protein can include other features described herein.

In another aspect, the invention features a protein (e.g., an isolated protein) that preferentially binds to a Tie1 protein in a dimeric conformation relative to a monomeric Tie1 protein. In one embodiment, the protein includes immunoglobulin HC and LC domains. In another embodiment, the protein includes a peptide (e.g., of length less than 30, 28, 25, 22, 20, 18, 16, or 14 amino acids) that independently binds to Tie1. For example, the peptide can include one, two, or three disulfide bonds. The protein can include other features described herein.

In another aspect, the invention features a protein (e.g., an isolated protein) that preferentially binds to a Tie2 protein in a conformation that is biased against interaction with Ang or Tie1. In one embodiment, the protein includes immunoglobulin HC and LC domains. In another embodiment, the protein includes a peptide (e.g., of length less than 30, 28, 25, 22, 20, 18, 16, or 14 amino acids) that independently binds to Tie2. For example, the peptide can include one, two, or three disulfide bonds. The protein can include other features described herein. The invention also features nucleic acid aptamers that have one or more of these properties.

In another aspect, the invention features a protein (e.g., an isolated protein) that preferentially binds to an Ang protein, and modulates (e.g., inhibits) interaction with Tie1 and Tie2. In one embodiment, the protein includes immunoglobulin HC and LC domains. In another embodiment, the protein includes a peptide (e.g., of length less than 30, 28, 25, 22, 20, 18, 16, or 14 amino acids) that independently binds to Ang. For example, the peptide can include one, two, or three disulfide bonds. The protein can include other features described herein. The invention also features nucleic acid aptamers that have one or more of these properties.

In another aspect, the invention features a protein (e.g., an isolated protein) that binds to an epitope of Tie1 ectodomain with a $K_D$ of less than $2 \times 10^{-7}$ M. The epitope overlaps, is within, or includes an epitope bound by E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein or that includes at least one, two, or three residues in common. For example, the protein binds with an affinity $K_D$ of less than $10^{-8}$ M, $5 \cdot 10^{-9}$ M, $10^{-9}$ M, $10^{-10}$ M, $10^{-11}$ M, or $10^{-12}$ M. In one embodiment, the protein includes immunoglobulin HC and LC domains. In another embodiment, the protein includes a peptide (e.g., of length less than 30, 28, 25, 22, 20, 18, 16, or 14 amino acids) that independently binds to Tie1. For example, the peptide can include one, two, or three disulfide bonds. The protein can include other features described herein. The invention also features nucleic acid aptamers that have one or more of these properties.

In another aspect, the invention features a protein (e.g., an isolated protein) that competitively inhibits binding of E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein to a Tie1 ectodomain. In one embodiment, the protein includes immunoglobulin HC and LC domains. In another embodiment, the protein includes a peptide (e.g., of length less than 30, 28, 25, 22, 20, 18, 16, or 14 amino acids) that independently binds to Tie1. For example, the peptide can include one, two, or three disulfide bonds. The protein can include other features described herein.

In another aspect, the invention features a protein (e.g., an isolated protein) that includes a heavy chain immunoglobulin variable domain sequence and a light chain immunoglobulin variable domain sequence and that antagonizes an activity of the Tie1 ectodomain. In one embodiment, CDR1 of the light chain variable domain sequence includes: Q-S-X-S-S (SEQ ID NO:151) or R-A-S-Q-S-X-S-S-Y-L-A (SEQ ID NO:152), wherein X is any amino acid or optionally aliphatic, e.g., isoleucine or valine. In one embodiment, CDR2 of the light chain variable domain sequence includes: A-S-$X_1$-R-$X_2$-T (SEQ ID NO:153) or D-A-S-$X_1$-R-$X_2$-T (SEQ ID NO:154), wherein $X_1$ is any amino acid or optionally a hydrophilic amino acid, e.g., serine or asparagine, and $X_2$ is any amino acid or optionally aliphatic or small aliphatic, e.g., alanine or valine. In one embodiment, CDR3 of the light chain variable domain sequence includes: Q-R-S-$X_2$-W-P-R (SEQ ID NO:155) or $X_1$-Q-R-S-$X_2$-W-P-R-T (SEQ ID NO:156), wherein $X_1$ is any amino acid or optionally leucine or glutamine, and $X_2$ is any amino acid or optionally lysine or serine.

In one embodiment, the protein competes with the B2 and/or D11 antibody for binding to Tie1 or competitively inhibits binding of B2 and/or D11 to Tie1.

In one embodiment, the protein antagonizes a Tie1 activity that is stimulated by the E3 or E3b antibody. In one embodiment, the protein inhibits dimerization of Tie1. The protein can include other features described herein.

In another aspect, the invention features an isolated, monospecific protein including a heavy chain immunoglobulin variable domain sequence and a light chain immunoglobulin variable domain sequence, wherein the protein binds to Tie1 ectodomain and includes a human or non-mouse constant domain (e.g., a human IgG1, IgG2, IgG3, or IgG4 constant domain). The protein can include other features described herein.

In another aspect, the invention features an isolated, human antibody that binds to a Tie1 ectodomain. The protein can include other features described herein.

In another aspect, the invention features an isolated antibody (e.g., an isolated antibody) that binds to a Tie1 ectodomain and contains less than 5, 4, 3, or 2 peptides (of between 6-9 amino acid length) that are non-human in origin or less than 5, 4, 3, or 2 peptides that are potential human T cell epitopes. In one embodiment, the antibody contains no peptide (of 6-9 amino acid length) that is non-human in origin or that is a potential human T cell epitope.

In one embodiment, the antibody is obtained by a method that includes deimmunization. For example, the antibody is deimmunized, e.g., completely deimmunized. The protein can include other features described herein.

In another aspect, the invention features an isolated antibody that binds to a Tie1 ectodomain and that includes a modified Fc domain, e.g., a modified human Fc domain. For example, antibodies may include modifications, e.g., that alter Fc function. For example, the human IgG1 constant region can be mutated at one or more residues, e.g., one or more of residues 234 and 237, e.g., according to the number in U.S. Pat. No. 5,648,260. Other exemplary modifications include those described in U.S. Pat. No. 5,648,260. The protein can include other features described herein.

In another aspect, the invention features an isolated protein that binds to the Tie1 receptor with an affinity $K_D$ of less than $10^{-7}$ M, $10^{-8}$ M, $5 \cdot 10^{-9}$ M, $10^{-9}$ M, $10^{-10}$ M, $10^{-11}$ M, or $10^{-12}$ M. The protein can include other features described herein.

In another aspect, the invention features an isolated protein including a heavy chain immunoglobulin variable domain sequence and a light chain immunoglobulin variable domain sequence, wherein the protein binds to Tie1 ectodomain and, for example, includes at least one or more CDRs that are a non-primate CDR (e.g., a non-mouse or non-rabbit CDR) or a synthetic CDR. The protein can include other features described herein.

In another aspect, the invention features an isolated nucleic acid including a coding sequence that encodes a polypeptide including an immunoglobulin HC variable domain of an antigen binding protein that binds to Tie1. The nucleic acid or polypeptide can include one or more other features described herein. The nucleic acid can include one or more altered codons. In one embodiment, the nucleic acid includes SEQ ID NOs:725 and/or 726. Also featured is a mammalian expression vector that includes SEQ ID NOs:725 and/or 726.

In one embodiment, the nucleic acid further includes a second coding sequence that encodes a polypeptide including an immunoglobulin HC variable domain, e.g., an HC domain described herein. In one embodiment, the nucleic acid further includes a promoter operably linked to the coding sequence.

In another aspect, the invention features a nucleic acid that includes one or more coding sequence that encodes one or more polypeptide chains that collectively include an immunoglobulin HC or LC variable domain of an antigen binding protein that binds to Tie1. In one embodiment, the nucleic acid segment encoding at least one of the variable domains hybridizes to a nucleic acid described herein, e.g., under stringent conditions (e.g., high stringency conditions), e.g., it hybridizes to a region encoding a variable domain and is at least 80, 85, 90, 95, or 98% of the length of such a region. The nucleic acid can include other features described herein.

In another aspect, the invention features a host cell that contains a first nucleic acid sequence encoding a polypeptide including a HC variable domain of an antigen binding protein and a second nucleic acid sequence encoding a polypeptide including a LC variable domain of the antigen binding protein, wherein the antigen binding protein binds to Tie1 with a $K_D$ of less than $2 \times 10^{-7}$ M. In one embodiment, the HC or LC variable domain includes at least one human CDR. The antigen binding protein can include other features described herein.

In another aspect, the invention features a host cell that contains a first nucleic acid encoding a polypeptide including a HC variable region and a second nucleic acid encoding a polypeptide including a LC variable region, wherein the HC and the LC variable regions each include at least 70, 80, 85, 90, 92, 95, 97, 98, 99, or 100% identical to respective amino acid sequences of the HC and LC variable domains of a clone selected from the group consisting of E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, and s-H4. The antigen binding protein can include other features described herein.

In another aspect, the invention features a pharmaceutical composition including a protein described herein that interacts with Tie1 and a pharmaceutically acceptable carrier.

In another aspect, the invention features a therapeutic composition including a protein described herein that interacts with Tie1 wherein the composition is sterile and suitable for administration to a subject.

In another aspect, the invention features a method that includes: providing a signal-dependent or signal-responsive cell that expresses a chimeric receptor including the Tie1 extracellular domain and a heterologous intracellular sequence that can produce a signal; contacting a candidate compound to the cell; and evaluating a property of the cell that is dependent on the signal. In one embodiment, the intracellular sequence includes at least a region of an intracellular sequence of the EpoR protein. The method can be used, e.g., to evaluate activity of a candidate compound, or a plurality of compounds.

In another aspect, the invention features a method that includes: providing an IL-3 dependent cell that expresses a chimeric receptor including the Tie1 extracellular domain and the EpoR intracellular domain; contacting a candidate compound to the cell under conditions in which the concentration of IL-3 is not sufficient to sustain viability of the cell; and evaluating a property of the cell. The method can be used, e.g., to evaluate activity of a candidate compound, or a plurality of compounds. In one embodiment, the property is viability. In one embodiment, the evaluating includes an MTT assay. In one embodiment, the method further includes administering the candidate compound to a subject. For example, the candidate compound includes a protein, e.g., a protein that includes an immunoglobulin variable domain.

In another aspect, the invention features method of identifying a compound that modulates Tie1 activity. The method includes: providing a plurality of candidate compounds; and evaluating each compound of the plurality using a method described herein.

In another aspect, the invention features a culture cell that expresses a chimeric transmembrane protein including a region of the Tie1 extracellular domain and a heterologous intracellular sequence. In one embodiment, the intracellular sequence includes a region of the EpoR intracellular domain. In one embodiment, the cell requires IL-3 or Tie1 for viability. For example, the cell is IL-3 dependent in the absence of the chimeric transmembrane protein, but is viable in the presence of the E3 or E3b antibody and the absence of IL-3.

In another aspect, the invention features a preparation that includes the isolated mammalian cells (e.g., cells that expresses a chimeric transmembrane protein including a region of the Tie1 extracellular domain and a heterologous intracellular sequence) and a Tie1-binding protein, wherein the Tie1-binding protein is necessary to sustain viability of the cells.

In another aspect, the invention features a kit including: a Tie1-binding protein and a culture cell that expresses a chimeric transmembrane protein including a region of the Tie1 extracellular domain and a heterologous intracellular sequence.

In another aspect, the invention features a method of evaluating a candidate compound. The method includes: providing a preparation that includes (i) a cell or membrane fraction that contains (a) an insoluble protein that includes a region of the Tie1 extracellular domain and a kinase domain and (b) ATP; (ii) a ligand that alters activity of the kinase domain; and (iii) the candidate compound; and evaluating the phosphorylation state of the insoluble protein.

In another aspect, the invention features a method of evaluating a candidate compound. The method includes: providing a preparation that includes (i) a cell or membrane fraction that includes a Tie1 protein or a transmembrane protein that includes at least a region of the Tie1 extracellular domain and ATP; (ii) a ligand that causes autophosphorylation of Tie1 or the transmembrane protein; and (iii) the candidate compound; and evaluating phosphorylation state of the Tie1 protein.

In one embodiment, the ligand is an antibody. In one embodiment, the ligand includes the HC and LC immunoglobulin variable domains of the E3 or E3b antibody or domains that are at least 90% identical in the CDR regions. In one embodiment, the method further includes administering the candidate compound to a subject.

In another aspect, the invention features a method that includes: providing a preparation that includes (i) a cell or membrane fraction that includes a transmembrane protein that includes at least a region of the Tie1 extracellular domain and ATP; and (ii) a ligand that causes autophosphorylation of Tie1 or the transmembrane protein; and evaluating phosphorylation state of the transmembrane protein.

In another aspect, the invention features a method that includes: contacting a mammalian cell with a ligand that (i) can agonize Tie1 autophosphorylation and/or (ii) can enable an IL-3 dependent cell that expresses a chimeric receptor including the Tie1 extracellular domain and the EpoR intracellular domain to remain viable under conditions in which the concentration of IL-3 is not sufficient to sustain viability of the cell; and evaluating the mammalian cell. In one embodiment, the cell expresses an endogenous Tie1 protein. In one embodiment, the cell is an endothelial cell. In one embodiment, the method further includes contacting the mammalian cell with a test compound, other than the ligand. For example, the ligand is an antibody. For example, the ligand includes the HC and LC immunoglobulin variable domains of the E3 or E3b antibody or domains that are at least 90% identical in the CDR regions.

In another aspect, the invention features a method that includes: contacting a mammalian cell or fraction thereof with an agent that can modulate the activity of Tie1; and evaluating the mammalian cell or fraction thereof. In one embodiment, the agent is contacted to the cell while the cell is living, and the evaluating includes isolating a fraction of the cell. In one embodiment, the agent is a protein, e.g., an antibody or a peptide. In one embodiment, the agent includes the HC and LC immunoglobulin variable domains of the E3 or E3b antibody or domains that are at least 90% identical in the CDR regions to the E3 or E3b antibody. In one embodiment, the agent includes the HC and LC immunoglobulin variable domains of the B2 or D11 antibody or domains that are at least 90% identical in the CDR regions to the B2 or D11 antibody. In one embodiment, the agent includes the HC and LC immunoglobulin variable domains of the A2, A10, P-B1, P-B3, or P-C6 antibody or domains that are at least 70, 80, 85, 90, 91, 92, 93, 94, 95, 96, 97, 98, 99, or 100% identical % identical in the CDR regions to the A2, A10, P-B1, P-B3, or P-C6 antibody. In one embodiment, the agent includes the HC and LC immunoglobulin variable domains of the G2 or C7 antibody or domains that are at least 90% identical in the CDR regions to the G2, or C7 antibody. The agent can include other features described herein.

In another aspect, the invention features a method of evaluating a test compound. The method includes evaluating interaction between an agent that can modulate the activity of Tie1 and a protein that includes at least a region of the Tie1 extracellular domain in the presence of the test compound. In one embodiment, the agent is a test compound is a small organic compound with molecular weight less than 8000, 7000, 6000, 5000, or 3000 Daltons. For example, the evaluating includes contacting cells that include the protein that includes at least a region of the Tie1 extracellular domain with the agent in the presence of the test compound. In another example, the evaluating includes forming a cell-free preparation that includes the protein that includes at least a region of the Tie1 extracellular domain, the agent, and the test compound.

In another aspect, the invention features an artificial protein complex that includes (i) a protein that includes a Tie1 extracellular domain and (ii) a Tie1 binding protein that can modulate (e.g., agonize or antagonize) an activity of Tie1. In one embodiment, the ligand is an antibody (e.g., an antibody described herein). For example, the ligand includes the HC and LC immunoglobulin variable domains of an antibody selected from the group consisting of: E3, E3b, B2, D11, A2, A10, P-B1, P-B3, P-C6, G2 and C7, or immunoglobulin domains that are at least 90% identical in the CDR regions to the CDR regions of the respective antibody. In one embodiment, the complex is present in a membrane fraction, on a mammalian cell, and/or in a subject.

In another aspect the invention features a method that includes: administering a composition that includes a protein that interacts with Tie1, Tie2, or Ang (e.g., a protein described herein) to a subject in an amount effective to reduce angiogenesis in the subject or otherwise treat or prevent a disorder in a subject. For example, the protein binds to Tie1, Tie2, or Ang with an affinity $K_D$ of less than $10^{-8}$ M, $5 \cdot 10^{-9}$ M, $10^{-9}$ M, $10^{-10}$ M, $10^{-11}$ M, or $10^{-12}$ M.

In one embodiment, the protein is a Tie1 binding protein. The protein can have at least two valencies, each of which binds to Tie1. For example, at least one, two, or all of the valencies can be binding sites that competes with E3 for binding to Tie1. In one embodiment, the protein competes with E3 for binding to Tie1 or binds to an epitope that overlaps the epitope bound by E3 on Tie1.

In one embodiment, the protein comprises a heavy chain immunoglobulin variable domain sequence and a light chain immunoglobulin variable domain sequence. The protein further includes one or more of the following properties: (1) at least one of the variable domain sequences comprising at least one CDR of the E3 antibody; (2) at least one of the variable domain sequences comprising CDR sequences at least 85% identical, in sum, to the CDRs of the corresponding variable domain of the E3 antibody; (3) at least one of the variable domains is at least 85% identical to the corresponding immunoglobulin variable domains of the E3 antibody, and (4) the protein competes with E3 for binding to Tie1 or binds to an epitope that overlaps the epitope bound by E3 on Tie1.

In one embodiment, one or more of the CDRs of the heavy and/or light chain variable domain sequence are human, primate, non-rodent (e.g., non-mouse or non-rat), or synthetic. In one embodiment, one or more of the framework regions of the heavy and/or light chain variable domain sequence are human, primate, or non-rodent (e.g., non-mouse or non-rat).

In one embodiment, the heavy chain includes one or more of the following properties:
i) a HC CDR1 that includes an amino acid sequence as follows:
(AGSR)-Y-(GVK)-M-(GSVF), (SEQ ID NO:117)
(AGSIMRH)-Y-(GVMK)-M-(GSVMFH) (SEQ ID NO:118), or
(AGSIMRNH)-Y-(AGTVMKPQ)-M-(AGSTVMYW-FKH) (SEQ ID NO:119);
ii) a HC CDR2 that includes an amino acid sequence as follows:
X-I-Y-P-S-G-G-X-T-X-Y-A-D-S-V-K-G (SEQ ID NO:120), wherein X is any amino acid,
(GSV)-I-(SY)-P-S-G-G-(WQ)-T-(GY) (SEQ ID NO:121),
(GSV)-I-(SY)-P-S-G-G-(WQ)-T-(GY)-Y-A-D-S-V-K-G (SEQ ID NO:122),
(GSVW)-I-(SY)-P-S-G-G-(AGVMYWPQH)-T-(AGSTLVMYFKH) (SEQ ID NO:123); or
X-I-Y-P-S-G-G-(WPS)-T-(YVH)-Y-A-D (SEQ ID NO:704), wherein X is any amino acid;
iii) a HC CDR3 that includes an amino acid sequence as follows:
V-(four or five residues)-F-D-(I/Y) (SEQ ID NO:124),
G-Y-G-P-I-A-P-G-L-D-Y (SEQ ID NO:125),
(GV)-N-Y-Y-(GYD)-S-(SD)-G-Y-G-P-I-A-P-G-L-D-Y (SEQ ID NO:126),
(GVD)-(AGLN)-(LYR)-(GSTLYH)-(GYD)-(AGSYFP)-(SFD)-(AGYD)-(IY)-(GFD)-(YDP)-(IP)-A-P-G-L-D-Y (SEQ ID NO:127),
VNYYDSSGYGPIAPGLDY (SEQ ID NO:128), or G-X-X-G-(AY)-F-D-(YI) (SEQ ID NO:705), wherein X is any amino acid.

In one embodiment, the light chain includes one or more of the following properties: i) a light chain cdr1 that includes an amino acid sequence as follows:
R-A-S-Q-S-(IV)-S-(SR)-X1-Y-L-(AN) (SEQ ID NO:129),
R-A-S-Q-S-(IV)-S-S-(YS)-L-(ALN) (SEQ ID NO:706),
T-G-T-(SN)-S-D-V-G-(GS)-Y (SEQ ID NO:707),
(SGQ)-(GS)-(DS)-(NS)-(IL)-(GR)-S-(YKN)-(YS)-(VA) (SEQ ID NO:708),
R-A-S-Q-S-V-S-S-X-L (SEQ ID NO:130),
R-A-S-Q-S-(IV)-S-(SR)-(SY)-(LY)-(ALN) (SEQ ID NO:131), OR
R-A-S-(REQ)-(GSTRN)-(IV)-(GSTIRN)-(STIRH)-X1-(SYWNH)-(LV)-(ASN) (SEQ ID NO:132), wherein X1 can be serine or absent;
ii) a LC CDR2 that includes an amino acid sequence as follows:
X-A-S-X-R-A-T (SEQ ID NO:133), wherein X can be any amino acid,
(AGD)-A-S-(STN)-R-A-T (SEQ ID NO:134),
(DG)-(AV)-S-N-(RL)-(AP)-ST) (SEQ ID NO:709),
(AGD)-A-S-(STN)-(LR)-(AEQ)-(ST) (SEQ ID NO:135), OR
(AGTKDEH)-A-S-(STN)-(LR)-(AVEQ)-(ST) (SEQ ID NO:136); AND
iii) a LC CDR3 that includes an amino acid sequence as follows:
Q-Q-(SYFR)-(GSYN)-S-(STYW)-(RP)-(LWR)-(TIY)-T (SEQ ID NO:137),
(LQ)-Q-(SYFR)-(GSYN)-(SKN)-(STYW)-(RP)-(LWR)-(TIY)-T (SEQ ID NO:138),
Q-Q-X-S-(SN)-(WS)-P-X-T-F (SEQ ID NO:710), wherein x is any amino acid,
Y-(TG)-(SG)-S-(PGS)-(TN)-X-(VT) (SEQ ID NO:711), wherein x is any amino acid,
Q-Q-(YR)-(GS)-S-(SW)-P-R-X1-T (SEQ ID NO:139), wherein X1 is any amino acid or absent,
(LQ)-(LQ)-(SYFRD)-(GSYN)-(STRKN)-(STYWF)-(RP)-(ILMWRH)-(TIY)-(TI) (SEQ ID NO:140), or
(LQ)-(LRQ)-(SYFRD)-(GSYN)-(ASTRKN)-(STYWF)-(SVRP)-(STILMWRH)-(TIY)-(STI) (SEQ ID NO:141).

In one embodiment, the heavy chain includes one or more of the following properties:
i) a HC CDR1 that includes an amino acid sequence as follows:
(AGSIMRH)-Y-(GVMK)-M-(GSVMFH) (SEQ ID NO:118), or
(AGSIMRNH)-Y-(AGTVMKPQ)-M-(AGSTVMYW-FKH) (SEQ ID NO:119);
ii) a HC CDR2 that includes an amino acid sequence as follows:
(GSV)-I-(SY)-P-S-G-G-(NWQ)-T-(GY) (SEQ ID NO:160),
(GSV)-I-(SY)-P-S-G-G-(NWQ)-T-(GY)-Y-A-D-S-V-K-G (SEQ ID NO:122), or
(GSVW)-I-(SY)-P-S-G-G-(AGVMYWPQH)-T-(AG-STLVMYFKH) (SEQ ID NO:123);
iii) a HC CDR3 that includes an amino acid sequence as follows:
APRGYSYGYYY (SEQ ID NO:712).

In one embodiment, the light chain includes one or more of the following properties: i) a LC CDR1 that includes an amino acid sequence as follows: R-A-S-(REQ)-(GSTRN)-(IV)-(GSTIRN)-(STIRH)-X1-(SYWNH)-(LV)-(ASN) (SEQ ID NO:132), wherein X1 can be serine or absent; ii) a LC CDR2 that includes an amino acid sequence as follows: (TAGD)-A-S-(STN)-(LR)-(AEQ)-(ST) (SEQ ID NO:713), or (AGTKDEH)-A-S-(STN)-(LR)-(AVEQ)-(ST) (SEQ ID NO:136); and iii) a LC CDR3 that includes an amino acid sequence as follows: Q-Q-(SYFR)-(GSYN)-S-(STYW)-(RP)-(LHWR)-(TIY) (SEQ ID NO:714), (LQ)-Q-(SYFR)-(GSYN)-(SKN)-(STYW)-(RP)-(LHWR)-(TIY) (SEQ ID NO:715), or (LQ)-(LQ)-(SYFRD)-(GSYN)-(STRKN)-(STYWF)-(RP)-(ILMWRH)-(TIY) (SEQ ID NO:716).

In one embodiment, the light chain includes one or more of the following properties: i) a LC CDR1 that includes an amino acid sequence as follows: S-X-(ND)-(IV)-(AG)-X1-X2-X3 (SEQ ID NO:142), or T-(GR)-(ST)-S-X5-(ND)-(IV)-(AG)-X1-X2-X3-Y-X4-S (SEQ ID NO:143), wherein X1 is any amino acid (e.g., G or R), X2 is any amino acid (e.g., Y or N), X3 is any amino acid (e.g., F, N, or K), X4 is any amino acid (e.g., aliphatic, e.g., V or A); iii) a LC CDR2 that includes an amino acid sequence as follows: (DE)-V-N-N-R-P-S (SEQ ID NO:144); (DE)-(VD)-(STDN)-(YRDN)-R-P-S (SEQ ID NO:145); v) a LC CDR3 that includes an amino acid sequence as follows: (SQ)-S-(SY)-(ASID)-(GSR)-(ST)-(STRN)-(STYR)-(ATLY)-(SVWQ) (SEQ ID NO:146).

In one embodiment, the HC CDR2 includes an amino acid sequence as follows: (GSVW)-I-(SY)-P-SG-G-(AGVMYW-PQH)-T-(AGSTLVMYFKH)-Y-(AT)-D-S-V-K-G (SEQ ID NO:147) or (GSV)-I-(SY)-P-SG-G-(WQ)-T-(GY)-Y-(AT)-D-S-V-K-G (SEQ ID NO:148).

In one embodiment, the HC CDR1 amino acid sequences have a length of at least 5 amino acids of which at least 3, 4, or 5 amino acids are identical to the CDR1 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the HC CDR2 amino acid sequences have a length of at least 15, 16, or 17 amino acids of which at least 10, 12, 14, 15, 16, or 17 amino acids are identical to the CDR2 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the HC CDR2 amino acid sequences have a length of at least 17 amino acids of which at least 14, 15, 16, or 17 amino acids are identical to the CDR2 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the HC CDR3 amino acid sequences have a length of at least of at least 7 or 8 amino acids of which at least 5, 6, 7, or 8 amino acids are identical to the CDR3 sequence of the HC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the LC CDR1 amino acid sequences have a length of at least 10, 11, or 12 amino acids of which at least 7, 8, 9, 10, or 11 amino acids are identical to the CDR1 sequence of the LC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D1, s-E11, s-G10, s-H4, or another antibody described herein. In one embodiment, the LC CDR2 amino acid sequences have a length of at least 6 or 7 amino acids of which at least 5, 6, or 7 amino acids are identical to the CDR2 sequence of the LC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. In one embodiment, the LC CDR3 amino acid sequences have a length of at least of at least 8, 9, or 10 amino acids of which at least 7, 8, 9, or 10 amino acids are identical to the CDR3 sequence of the LC of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein. sequence is at least 70, 80, 85, 90, 92, 95, 97, 98, 99, or 100% identical to the amino acid sequence of the HC variable domain of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the amino acid sequence of the HC variable domain

In one embodiment, the amino acid sequence of the LC variable domain sequence is at least 70, 80, 85, 90, 92, 95, 97, 98, 99, or 100% identical to the amino acid sequence of the LC variable domain of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G01, s-H4, or another antibody described herein.

In one embodiment, the amino acid sequences of the HC and LC variable domain sequences are at least 70, 80, 85, 90, 92, 95, 97, 98, 99, or 100% identical to the amino acid sequences of the HC and LC variable domains of a clone selected from the group consisting of E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, and s-H4.

In one embodiment, the amino acid sequences of one or more framework regions (e.g., FR1, FR2, FR3, and/or FR4) of the HC and/or LC variable domain are at least 70, 80, 85, 90, 92, 95, 97, 98, 99, or 100% identical to corresponding framework regions of the HC and LC variable domains of clone E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one embodiment, the light chain variable domain sequence is human or non-immunogenic in a human. In one embodiment, the heavy chain variable domain sequence is human or non-immunogenic in a human.

The protein can bind to cells that express Tie1, e.g., endothelial cells. In one embodiment, the protein does not substantially bind (e.g., does not detectably bind) to platelets.

In one embodiment, the protein specifically binds to Tie1, e.g., it binds with at least a 10, 50, 100, $10^3$, or $10^4$ fold preference for Tie1 relative to another human protein, e.g., Tie2, a natural protein other than Tie1 that has a Ig-like domain, an EGF-like domain, or fibronectin Type III repeat, or human serum albumin. In one embodiment, the protein binds to a domain of Tie1 described herein.

In one embodiment, the protein is delivered locally. In one embodiment, the protein is delivered systemically.

In one embodiment, the subject is in need of reduced angiogenesis, or identified as such. For example, the subject has an angiogenesis-related disorder. In another example, the subject has a neoplastic disorder, e.g., a metastatic cancer. For example, the subject has an angiogenesis-dependent cancer or tumor. The tumor can be a solid tumor, e.g., a tumor at least 1, 2, 3, 5, 8 or 10 mm in diameter. In one embodiment, the solid tumor has a hypoxic core. The method can further include administering an anti-metabolite (e.g., 5-FU, with leucovorin), irinotecan, (or other topoisomerase inhibitor), doxorubicin, bevacizumab, or all of these agents. The method can include, prior to administering the antagonist, evaluating the subject and detecting a solid tumor in the subject.

In another embodiment, the subject has an inflammatory disorder, e.g., rheumatoid arthritis, psoriasis, rheumatoid or rheumatic inflammatory disease, or other chronic inflammatory disorders, such as chronic asthma, arterial or post-transplantational atherosclerosis, and endometriosis. Other disorders that can be treated include those that have deregulated or undesired angiogenesis, such as ocular neovascularization, e.g., retinopathies (including diabetic retinopathy and age-related macular degeneration) hemangioblastoma, hemangioma, and arteriosclerosis.

In one embodiment, the protein is administered in an amount effective to reduce one or more of the following activities: sprouting, splitting and remodeling of blood vessels. In one embodiment, the protein is administered in an amount effective to reduce vasculogenesis or tubule formation.

In one embodiment, the method further includes, prior to the administering, identifying the subject as a subject in need of reduced angiogenesis. In one embodiment, the method further includes administering the protein continuously or in separate boluses. In one embodiment, the method further includes monitoring the subject during the course of administration. For example, the monitoring includes imaging blood vessels (locally or throughout) the subject. In another example, the monitoring include evaluating tumor size or tumor load in the subject.

In another aspect the invention features a method that includes: administering a composition that includes a protein described herein (e.g., a protein that reduces a Tie1 activity) to a subject in an amount effective to reduce a Tie1 activity in the subject. The method can include other features described herein.

In another aspect the invention features a method that includes: administering a composition that includes a protein described herein (e.g., a protein that can modulate an activity of Tie1) to a subject in an amount effective to modulate endothelial cell activity in the subject. In one embodiment, the protein is delivered into the circulation.

In one embodiment, the composition is effective for sensitizing endothelial cells to a treatment, and providing a treatment to the subject that inhibits, kills, ablates, or otherwise arrests the sensitized endothelial cells.

In another aspect the invention features a method that includes: (i) contacting the sample (and optionally, a reference, e.g., control, sample) with a protein that binds to Tie1, e.g., a protein described herein, under conditions that allow interaction of the Tie1-binding protein and the Tie1 protein to occur; and (ii) detecting formation of a complex between the Tie1-binding protein, and the sample (and optionally, the reference, e.g., control, sample).

In another aspect the invention features a method that includes: (i) administering to a subject (and optionally a control subject) a Tie1-binding protein (e.g., an antibody or antigen binding fragment thereof), under conditions that allow interaction of the Tie1-binding protein and the Tie1 protein to occur; and (ii) detecting formation of a complex between the Tie 1-binding protein and a Tie1 molecule of the subject or detecting distribution of Tie1-binding protein or at least one location of the Tie1-binding protein in the subject. In one embodiment, the Tie1-binding protein does not modulate the activity of Tie1. The Tie1-binding protein can be a protein described herein. In one embodiment, the ligand detects activated Tie1.

An antibody that binds to Tie1 is preferably monospecific, e.g., a monoclonal antibody, or antigen-binding fragment thereof. For example, the antibody can recognize Tie1 on a living cell, e.g., an endogenous Tie1 molecule or a Tie1 molecule that is expressed from a heterologous nucleic acid. In one embodiment, the Tie1-binding protein interacts with primary endothelial cells. The term "monospecific antibody" refers to an antibody that displays a single binding specificity and affinity for a particular target, e.g., epitope. This term includes a "monoclonal antibody" which refers to an antibody that is produced as a single molecular species, e.g., from a population of homogenous isolated cells. A "monoclonal antibody composition" refers to a preparation of antibodies or fragments thereof of in a composition that includes a single molecular species of antibody. In one embodiment, a monoclonal antibody is produced by a mammalian cell. One or more monoclonal antibody species may be combined.

The Tie1-binding antibodies can be full-length (e.g., an IgG (e.g., an IgG1, IgG2, IgG3, IgG4), IgM, IgA (e.g., IgA1, IgA2), IgD, and IgE) or can include only an antigen-binding fragment (e.g., a Fab, F(ab')$_2$ or scFv fragment), e.g., it does not include an Fc domain or a CH2, CH3, or CH4 sequence. The antibody can include two heavy chain immunoglobulins and two light chain immunoglobulins, or can be a single chain antibody. The antibodies can, optionally, include a constant region chosen from a kappa, lambda, alpha, gamma, delta, epsilon or a mu constant region gene. A Tie1-binding antibody can include a heavy and light chain constant region substantially from a human antibody, e.g., a human IgG1 constant region or a portion thereof.

In one embodiment, the antibody (or fragment thereof) is a recombinant or modified antibody, e.g., a chimeric, a humanized, a deimmunized, or an in vitro generated antibody. The term "recombinant" or "modified" human antibody, as used herein, is intended to include all antibodies that are prepared, expressed, created or isolated by recombinant means, such as antibodies expressed using a recombinant expression vector transfected into a host cell, antibodies isolated from a recombinant, combinatorial antibody library, antibodies isolated from an animal (e.g., a mouse) that is transgenic for human immunoglobulin genes or antibodies prepared, expressed, created or isolated by any other means that involves splicing of human immunoglobulin gene sequences to other DNA sequences. Such recombinant antibodies include humanized, CDR grafted, chimeric, deimmunized, in vitro generated antibodies, and may optionally include constant regions derived from human germline immunoglobulin sequences.

In one embodiment, the antibody binds to an epitope distinct from an epitope bound by known monoclonal antibodies that bind to Tie1, e.g., an antibody described in WO 95/26364, e.g., 3C4C7G6 and 10F11G6. In other embodiments, the antibody does not compete with known monoclonal antibodies that bind to Tie1, e.g., 3C4C7G6 and 10F11G6. In still other embodiments, the antibody does not compete with ligand described herein, e.g., the E3 antibody.

Also within the scope of the invention are antibodies or other agents (e.g., protein or non-protein agents) that bind overlapping epitopes of, or competitively inhibit the binding of the proteins disclosed herein, e.g., proteins that bind to Tie1, Tie2, or Ang. For example, the antibodies or other agents bind overlapping epitopes of or competitively inhibit the binding of monospecific antibodies, e.g., E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein to Tie 1, or vice versa (e.g., the monospecific antibodies competitively inhibiting binding of the ligands). Overlapping epitopes can include at least one amino acid in common. Agents that competitively inhibit binding of one another do not necessarily bind to overlapping epitopes. For example, they may inhibit binding by steric interference or by altering the conformation of Tie1.

Any combination of binding proteins is within the scope of the invention, e.g., two or more antibodies that bind to different regions of Tie1, Tie2, or Ang, e.g., antibodies that bind to two different epitopes on the extracellular domain of Tie1, Tie2, or Ang, e.g., a bispecific antibody.

In one embodiment, the Tie 1-binding antibody or antigen-binding fragment thereof includes at least one light or heavy chain immunoglobulin (or preferably, at least one light chain immunoglobulin and at least one heavy chain immunoglobulin). Preferably, each immunoglobulin includes a light or a heavy chain variable region having at least one, two and, preferably, three complementarity determining regions (CDRs) substantially identical to a CDR from an anti-Tie1 light or heavy chain variable region, respectively, i.e., from a variable region of an antibody described herein, e.g., E3, E3b, G2, p-A1, p-A10, p-B1, p-B3, p-C6, p-D12, p-F3, p-F4, p-G3, s-A10, s-H1, s-A2, s-B2, s-B9, s-C10, s-C2, s-C7, s-D11, s-E11, s-G10, s-H4, or another antibody described herein.

In one aspect, the invention features an agent (e.g., an antibody) that decreases endothelial cell activity by increasing Tie1 phosphorylation. In one embodiment, the agent decreases endothelial cell differentiation, e.g., sprouting, splitting, and tube formation.

In one aspect, the invention features an agent (e.g., an antibody) that decreases endothelial cell activity by activating a signaling pathway. In one embodiment, the antibody decreases endothelial cell differentiation, e.g., sprouting, splitting, and tube formation. This agent-induced effect can be independent or dependent of Tie1 self-association.

In one aspect, the invention features an isolated protein that includes a heavy chain immunoglobulin variable domain sequence and a light chain immunoglobulin variable domain sequence, wherein the protein binds to Tie1 ectodomain and the heavy chain immunoglobulin variable domain sequence includes one or more of the following properties: i) a HC CDR1 that includes an amino acid sequence of a clone from the group consisting of: M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G04; M0044-G07; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H1; M0047-B03; M0047-D01; M0047-D03; M0047-E10; M0047-G09; M0053-A02; M0053-A03; M0053-A05; M0053-A09; M0053-B09; M0053-B1; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F11; M0056-G03; M0056-G04; M0056-G08; M0056-G12; M0056-H04; M0056-H12; M0057-B05; M0057-H07;

M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M0061-G12; M0061-H09; M0062-A12; M0062-B05; M0062-B07; M0062-C08; M0062-D04; M0062-E02; M0062-E03; M0062-E11; M0062-F10; M0062-G06; and M0062-H01, or a sequence that is at least 70, 75, 80, 85, or 90% identical to such a sequence; ii) a HC CDR2 that includes an amino acid sequence of a clone from the group consisting of: M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H11; M0047-B03; M0047-D01; M0047-D03; M0047-E10; M0047-G09; M0053-A02; M0053-A03; M0053-A05; M0053-A09; M0053-B09; M0053-B11; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F11; M0056-G03; M0056-G04; M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M0061-G12; M0061-H09; M0062-A12; M0062-B05; M0062-B07; M0062-C08; M0062-D04; M0062-E02; M0062-E03; M0062-E11; M0062-F10; M0062-G06; and M0062-H01, or a sequence that is at least 70, 75, 80, 85, or 90% identical to such a sequence; iii) a HC CDR3 that includes an amino acid sequence of a clone from the group consisting of: M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H1; M0047-B03; M0047-D01; M0047-D03; M0047-E10; M0047-G09; M0053-A02; M0053-A03; M0053-A05; M0053-A09; M0053-B09; M0053-B11; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F1; M0056-G03; M0056-G04; M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M0061-G12; M0061-H09; M0062-A12; M0062-B05; M0062-B07; M0062-C08; M0062-D04; M0062-E02; M0062-E03; M0062-E1; M0062-F10; M0062-G06; and M0062-H01, or a sequence that is at least 70, 75, 80, 85, or 90% identical to such a sequence.

In one embodiment, the protein also includes the light chain immunoglobulin variable domain sequence which includes one or more of the following properties: i) a LC CDR1 that includes an amino acid sequence of a clone from the group consisting of: M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H11; M0047-B03; M0047-D01; M0047-D03; M0047-E10; M0047-G09; M0053-A02; M0053-A03; M0053-A05; M0053-A09; M0053-B09; M0053-B11; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F11; M0056-G03; M0056-G04; M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M0061-G12; M0061-H09; M0062-A12; M0062-B05; M0062-B07; M0062-C08; M0062-D04; M0062-E02; M0062-E03; M0062-E11; M0062-F10; M0062-G06; and M0062-H01, or a sequence that is at least 70, 75, 80, 85, or 90% identical to such a sequence; ii) a LC CDR2 that includes an amino acid sequence of a clone from the group consisting of: M0044-A06; M0044-A11; M0044-B04; M0044-B5; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H11; M0047-B03; M0047-D01; M0047-D03; M0047-E10; M0047-G09; M0053-A02; M0053-A03; M0053-A05; M0053-A09;

M0053-B09; M0053-B11; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F1; M0056-G03; M0056-G04; M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M0061-G12; M0061-H09; M0062-A12; M0062-B05; M0062-B07; M0062-C08; M0062-D04; M0062-E02; M0062-E03; M0062-E11; M0062-F10; M0062-G06; and M0062-H01, or a sequence that is at least 70, 75, 80, 85, or 90% identical to such a sequence; iii) a LC CDR3 that includes an amino acid sequence of a clone from the group consisting of: M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G007; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H11; M0047-B03; M0047-D01; M0047-D03; M0047-E10; M0047-G09; M0053-A02; M0053-A03; M0053-A05; M0053-A09; M0053-B09; M0053-B1; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F11; M0056-G03; M0056-G04; M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M0061-G12; M0061-H09; M0062-A12; M0062-B05; M0062-B07; M0062-C08; M0062-D04; M0062-E02; M0062-E03; M0062-E11; M0062-F10; M0062-G06; and M0062-H01, or a sequence that is at least 70, 75, 80, 85, or 90% identical to such a sequence.

In one embodiment, the protein includes the amino acid sequence of the HC variable domain sequence which is at least 85, 90, 95, 98, or 99% identical to the amino acid sequence of the HC variable domain of clone M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H11; M0047-B03; M0047-D01; M0047-D03; M0047-E10; M0047-G09; M0053-A02; M0053-A03; M0053-A05; M0053-A09; M0053-B09; M0053-B11; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F11; M0056-G003; M0056-G04; M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M0061-G12; M0061-H09; M0062-A12; M0062-B05; M0062-B07; M0062-C08; M0062-D04; M0062-E02; M0062-E03; M0062-E11; M0062-F10; M0062-G06; or M0062-H01.

In one embodiment, the protein includes the amino acid sequence of the LC variable domain sequence which is at least 85, 90, 95, 98, or 99% identical to the amino acid sequence of the LC variable domain of clone M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H11; M0047-B03; M0047-D01; M0047-D03; M0047-E10; M0047-G09; M0053-A02; M0053-A03; M0053-A05; M0053-A09; M0053-B09; M0053-B11; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F11; M0056-G03; M0056-G04; M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M0061-G12; M0061-H09; M0062-A12; M0062-B05;

M0062-B07; M0062-C08; M0062-D04; M0062-E02; M0062-E03; M0062-E11; M0062-F10; M0062-G06; or M0062-H01.

An antibody or other binding protein (e.g., a Tie1-binding protein, Tie2-binding protein, or Ang binding protein) described herein can be administered to a subject or used in vitro in non-derivatized or unconjugated forms. In other embodiments, the binding protein can be derivatized, modified or linked to another functional molecule, e.g., another protein (e.g., HSA, an Fc domain, etc.), a polymer (e.g., PEG) isotope, cell, or insoluble support. For example, the binding protein can be functionally linked (e.g., by chemical coupling, genetic fusion, non-covalent association or otherwise) to one or more other molecular entities, such as an antibody (e.g., if the protein is an antibody to form a bispecific or a multi-specific antibody), a toxin, a radioisotope, a therapeutic (e.g., a cytotoxic or cytostatic) agent or moiety, among others. For example, the binding protein can be coupled to a radioactive ion (e.g., an α-, γ-, or β-emitter), e.g., iodine ($^{131}$I or $^{125}$I), yttrium ($^{90}$Y), lutetium ($^{177}$Lu), actinium ($^{225}$Ac), rhenium ($^{186}$Re), or bismuth ($^{212}$Bi or $^{213}$Bi).

In another aspect, the invention features a nucleic acid that includes a coding sequence that encodes a polypeptide comprising an immunoglobulin heavy or light chain variable domain that binds to Tie1, e.g., an immunoglobulin heavy or light chain variable domain described herein. For example, the nucleic acid can include a particular nucleic acid sequence described herein, a nucleic acid that is at least 75, 80, 85, 90, 95, 96, 97, 98, or 99% identical to a nucleic acid sequence described herein (e.g., a particular nucleic acid sequence), or a nucleic acid that specifically hybridizes (e.g., under conditions described herein, e.g., high stringency conditions) to a nucleic acid sequence described herein (e.g., a particular nucleic acid sequence, e.g., a nucleic acid encoding one or more variable domains of M0044-A06; M0044-A11; M0044-B04; M0044-B05; M0044-B08; M0044-B09; M0044-B10; M0044-B12; M0044-C07; M0044-D01; M0044-E03; M0044-F03; M0044-F06; M0044-F09; M0044-G06; M0044-G07; M0044-G11; M0044-H03; M0044-H05; M0044-H07; M0044-H09; M0045-A02; M0045-A04; M0045-B01; M0045-B03; M0045-B11; M0045-C02; M0045-C11; M0045-C12; M0045-D01; M0045-D07; M0045-G01; M0045-G10; M0046-A11; M0046-B06; M0046-B10; M0046-G12; M0046-H03; M0046-H10; M0046-H1; M0047-B03; M0047-D01; M0047-D03; M0047-E10; M0047-G09; M0053-A02; M0053-A03; M0053-A05; M0053-A09; M0053-B09; M0053-B11; M0053-D03; M0053-D06; M0053-D12; M0053-E03; M0053-E04; M0053-E08; M0053-F04; M0053-F05; M0053-F06; M0053-F08; M0053-G04; M0053-G05; M0054-A08; M0054-B06; M0054-B08; M0054-C03; M0054-C07; M0054-E04; M0054-G01; M0054-G05; M0054-H10; M0055-A09; M0055-B11; M0055-B12; M0055-C05; M0055-C07; M0055-D03; M0055-D06; M0055-D12; M0055-E04; M0055-E06; M0055-E10; M0055-E12; M0055-F10; M0055-G02; M0055-G03; M0055-H04; M0056-A01; M0056-A06; M0056-B08; M0056-B09; M0056-C03; M0056-C04; M0056-E08; M0056-F01; M0056-F02; M0056-F10; M0056-F11; M0056-G03; M0056-G04; M0056-G08; M0056-G12; M0056-H04; M0056-H12; M0057-B05; M0057-H07; M0058-A09; M0058-D04; M0058-E09; M0058-F03; M0058-G03; M0058-H01; M0059-A02; M0059-A06; M0060-B02; M0060-H01; M0061-A03; M0061-C05; M0061-C06; M0061-F07; M0061-G12; M0061-H09; M0062-A12; M0062-B05; M0062-B07; M0062-C08; M0062-D04; M0062-E02; M0062-E03; M0062-E11; M0062-F10; M0062-G06; or M0062-H01), or fragments thereof (e.g., CDR-coding fragments).

A nucleic acid described herein can further include a promoter operably linked to the coding sequence. A nucleic acid can include a first and second coding sequence, e.g., wherein the first coding sequence encodes a polypeptide that includes an immunoglobulin heavy chain variable domain and the second coding sequence encodes a polypeptide that includes an immunoglobulin light chain variable domain.

In another aspect, the invention features a host cell that contains a first nucleic acid encoding a polypeptide comprising a heavy chain variable region and a second nucleic acid encoding a polypeptide comprising a light chain variable region. The heavy chain variable region and the light chain variable region can associate to form a Tie1 binding protein. These variable regions can have one or more properties described herein, e.g., at least 75, 80, 85, 90, 95, 96, 97, 98, or 99% identity to a sequence described herein. The invention also includes a method of providing a Tie1-binding antibody. The method can include providing a host cell described herein; and expressing said first and second nucleic acids in the host cell under conditions that allow assembly of said light and heavy chain variable regions to form an antigen binding protein that interacts with Tie1.

In another aspect, the invention provides compositions, e.g., pharmaceutical compositions, which include a pharmaceutically acceptable carrier, excipient or stabilizer, and at least one of the Tie1-binding proteins (e.g., antibodies or fragments thereof) described herein. In one embodiment, the compositions, e.g., the pharmaceutical compositions, include a combination of two or more of the aforesaid Tie1-binding proteins.

In another aspect, the invention features a kit that includes a Tie1-binding antibody (or fragment thereof), e.g., a Tie1-binding antibody (or fragment thereof) as described herein, for use alone or in combination with other therapeutic modalities, e.g., a cytotoxic or labeling agent, e.g., a cytotoxic or labeling agent as described herein, along with instructions on how to use the Tie1 antibody or the combination of such agents to treat, prevent or detect a Tie1-related disorder, e.g., an endothelial cell related disorder, e.g., rheumatoid arthritis or metastatic cancer.

In another aspect, the binding protein that binds to Tie1 is a polypeptide that is not an immunoglobulin. For example, the polypeptide can be of variable length, e.g., 4 to 100 amino acid residues in length, preferably 5 to 75, 6 to 50, or 7 to 40 amino acid residues in length, or more preferably 8 to 30 or 10 to 25 amino acid residues in length. In some embodiments, the polypeptide includes non-standard or synthetic amino acid residues, e.g., norleucine, selenocysteine, pyrrolysine, etc. In some embodiments, the polypeptide includes cross-linking groups, e.g., two cysteine residues that can form a disulfide bond or some other type of chemical cross-linking moieties that can be used to cyclize the peptide. In other preferred embodiments, the polypeptide can be modified, e.g., using polyethylene glycol or fusion to a soluble protein, e.g., to increase the solubility or circulatory half-life of the polypeptide.

The target-binding protein can be physically associated with (e.g., fused to) another protein, e.g., a protein that does not bind to the target, e.g., to the amino or carboxy terminus. For example, the target-binding protein can be associated with (e.g., fused to) a protein that increases serum residence or alters stability, e.g., an albumin, e.g., a serum albumin, e.g., HSA (human serum albumin). In another example, the target binding protein is physically associated with (e.g., fused to) a moiety that facilitates purification, e.g., a purification tag such as His, PEG, or to a functional moiety, e.g., Fc.

In another aspect, the invention features a method of identifying a protein that specifically binds to Tie1. In preferred embodiments, the invention includes: providing a Tie1 antigen; providing a display library (e.g., a phage display library member); identifying a member present in the library, wherein the member expresses a protein that specifically binds to the Tie1 antigen. The term "Tie1 antigen" refers to any antigenic fragment of Tie1 that is at least 8 amino acids in length. For example, a Tie1 antigen can include a fragment of the Tie1 ectodomain, e.g., a fragment that includes a folded protein domain such as a fragment described herein. In some embodiments, the Tie1 antigen is of human origin and includes, e.g., the extracellular domain of human Tie1 or a fragment thereof (e.g., a fragment described herein. The Tie1 antigen can be a recombinant polypeptide optionally fused to another polypeptide, e.g., a Fc domain, or it can be a cell that expresses Tie1 on its surface (e.g., an endothelial cell). In other preferred embodiments, the Tie1 antigen has an activated conformation, e.g., the Tie1 antigen is a dimeric conformation or a conformation stabilized by the E3 or E3b antibody described herein.

The methods described here are, for example, applicable to libraries that are based on bacteriophage with a substantially complete genome (e.g., including a modified gene III) and to libraries that are based on bacteriophage particles that include a phagemid nucleic acid. The terms "bacteriophage library member" and "phage" encompass members of both types of libraries. The term "bacteriophage particle" refers to a particle formed of bacteriophage coat proteins that packages a nucleic acid. The packaged nucleic acid can be a modified bacteriophage genome or a phagemid, e.g., a nucleic acid that includes a bacteriophage origin of replication but lacks essential phage genes and cannot propagate in *E. coli* without help from "helper phage" or phage genes supplied in trans.

In other embodiments, the invention features a method of identifying a protein that specifically binds to Tie1. The method includes: providing a Tie1 antigen (e.g., an region of the Tie1 ectodomain); immunizing a non-human animal with the Tie1 antigen; and isolating a cell that produces a immunoglobulin that interacts with Tie1. For example, the method can include producing hybridoma cells from the spleen of the animal (e.g., an immunized mouse); and identifying individual hybridoma cell lines expressing an antibody that specifically binds to the Tie1 antigen. For example, the In preferred embodiments, the Tie1 antigen is of human origin and includes, e.g., the extracellular domain of human Tie1 or some fragment thereof, e.g., the HA binding domain of Tie1. The Tie1 antigen can be a recombinant polypeptide optionally fused to another polypeptide, e.g., a purification handle, or it can be a cell that expresses Tie1 (e.g., an endothelial cell) on its surface. In other preferred embodiments, the Tie1 antigen has an activated conformation, e.g., dimerized.

In preferred embodiments, the methods further include isolating a nucleic acid molecule from the identified phage or hybridoma, wherein the nucleic acid molecule encodes the polypeptide or antibody that specifically binds to the Tie1 antigen. The isolated nucleic acid molecules can be used to produce therapeutic agents, as described herein.

In another aspect, the invention features nucleic acids that encode proteins identified by the methods described herein. In preferred embodiments, the nucleic acids include sequences encoding a heavy and light chain immunoglobulin or immunoglobulin fragment described herein. For example, the invention features, a first and second nucleic acid encoding a heavy and light chain variable region, respectively, of a Tie1-binding antibody molecule as described herein. Sequences encoding a heavy and light chain that function together can be present on separate nucleic acid molecules or on the same nucleic acid molecule. In another aspect, the invention features host cells and vectors containing a nucleic acid described herein.

In yet another aspect, the invention features a method of producing a Tie1-binding antibody, or antigen-binding fragment thereof. The method includes: providing a host cell that contains a first nucleic acid encoding a polypeptide comprising a heavy chain variable region, e.g., a heavy chain variable region as described herein; providing a second nucleic acid encoding a polypeptide comprising a light chain variable region, e.g., a light chain variable region as described herein; and expressing said first and second nucleic acids in the host cell under conditions that allow assembly of said light and heavy chain variable regions to form an antigen binding protein that interacts with Tie1. The first and second nucleic acids can be linked or unlinked, e.g., expressed on the same or different vector, respectively. The first and second nucleic acids can be components of the same molecule or can reside on different molecules (e.g., different chromosomes or plasmids).

The host cell can be a eukaryotic cell, e.g., a mammalian cell, an insect cell, a yeast cell, or a prokaryotic cell, e.g., *E. coli*. For example, the mammalian cell can be a cultured cell or a cell line. Exemplary mammalian cells include lymphocytic cell lines (e.g., NS0), Chinese hamster ovary cells (CHO), COS cells, HEK294, oocyte cells, and cells from a transgenic animal, e.g., mammary epithelial cell. For example, nucleic acids encoding the antibodies described herein can be expressed in a transgenic animal. In one embodiment, the nucleic acids are placed under the control of a tissue-specific promoter (e.g., a mammary specific promoter) and the antibody is produced in the transgenic animal. For example, the antibody molecule is secreted into the milk of the transgenic animal, such as a transgenic cow, pig, horse, sheep, goat or rodent. To produce a single chain antibody, the nucleic acid is configured to encode a single polypeptide that comprises both the heavy and light chain variable domains.

Tie1 has been found to be overexpressed in association with a wide range of cancers. Targeting Tie1 on the tumor vasculature with Tie1-binding proteins (e.g., antibodies) can be used to inhibit, destroy, or otherwise antagonize the vasculature so that tumor growth and metastasis is reduced. The proteins can be, for example, associated with a toxic payload or can mediate direct functional inhibition. Proteins (e.g., proteins that have an Fc domain) that can cause ADCC can also be used.

In another aspect, the invention features a method of inhibiting an activity of a cell, e.g., an endothelial cell, e.g., proliferation, adhesion, growth or survival of a cell, e.g., an endothelial cell, e.g., an endothelial cell in the vicinity of a cancer, e.g., a tumor. Exemplary methods include contacting the cell with a Tie1 binding protein, in an amount sufficient to inhibit the adhesion, migration, growth or proliferation of the cell. Methods of administering a Tie1 binding protein can be used, for example, to treat or prevent a disorder, e.g., an inflammatory disorder (e.g., rheumatoid arthritis, lupus, restenosis, psoriasis, graft v. host response, or multiple sclerosis), or a cancerous disorder (e.g., a malignant or metastatic disorder), by administering to a subject (e.g., an experimental animal or a human patient) a Tie1-binding protein in an amount effective to treat or prevent such disorder.

A Tie1-binding protein can be used to treat or prevent angiogenesis-related disorders, particularly angiogenesis-dependent cancers and tumors. Angiogenesis-related disorders include, but are not limited to, solid tumors; tumor metastasis; benign tumors (e.g., hemangiomas, acoustic neuromas, neurofibromas, trachomas, and pyogenic granulomas; rheumatoid arthritis); psoriasis; ocular angiogenic diseases, for example, diabetic retinopathy, retinopathy of prematurity, macular degeneration, corneal graft rejection, neovascular glaucoma, retrolental fibroplasia, rubeosis; Osler-Webber Syndrome; myocardial angiogenesis; plaque neovascularization; telangiectasia; hemophiliac joints; angiofibroma; and wound granulation.

"Angiogenesis-dependent cancers and tumors" are cancers tumors that require, for their growth (expansion in volume and/or mass), an increase in the number and density of the blood vessels supplying then with blood. In one embodiment a Tie1-binding protein causes regression of such cancers and tumors. "Regression" refers to the reduction of tumor mass and size, e.g., a reduction of at least 2, 5, 10, or 25%.

In addition, Tie1 and Tie2 are also expressed in hematopoietic cells. (Kukk et al (1997) Br. J. Haematol. 98: 195; Iwama et al (1993) Biochem. Biophys. Res. Commun. 195: 301). Accordingly, in another embodiment, a Tie1-binding protein is used to treat hematopoietic conditions, e.g., hematopoietic cancers. Examples of hematopoietic cancers include: cancers derived from hyperplastic/neoplastic cells of hematopoietic origin, e.g., cells arising from myeloid, lymphoid or erythroid lineages, or precursor cells thereof. Exemplary cancers include acute promyeloid leukemia (APML), acute myelogenous leukemia (AML), chronic myelogenous leukemia (CML), acute lymphoblastic leukemia (ALL), chronic lymphocytic leukemia (CLL), prolymphocytic leukemia (PLL), hairy cell leukemia (HLL) and Waldenstrom's macroglobulinemia (WM), non-Hodgkin's lymphoma, peripheral T-cell lymphomas, adult T-cell leukemia/lymphoma (ATL), cutaneous T-cell lymphoma (CTCL), large granular lymphocytic leukemia (LGF), B cell chronic lymphocytic leukemia, myelodysplastic syndrome, and Hodgkin's disease.

In another aspect, the invention features a method of contacting a cell (in vitro, ex vivo, or in vivo), e.g., an endothelial cell, e.g., an endothelial cell in the vicinity of a cancer, e.g., a tumor. The method can include providing an agent (e.g., a protein) that interacts with Tie1, e.g., a protein described herein, and contacting the cell with the protein, in an amount sufficient to form at least one detectable ligand-cell complex. The protein can include, for example, a label or cytotoxic entity, e.g., an immunoglobulin Fc domain or a cytotoxic drug.

In another aspect, the invention features administering the agent described herein as an adjuvant therapy, e.g., to a subject. The adjuvant therapy can be a post-operative therapy that is administered to the subject after the subject has undergone surgery to remove all or part of a tumor (e.g., after surgery to treat glioblastoma or colorectal, breast, or lung cancer). For example, the agent is a protein that inhibits Tie complex formation, promotes Tie1 homodimerization, or increases Tie1 phosphorylation. For example, the agent is a protein that binds Tie1 (e.g., an anti-Tie1 antibody). In one embodiment, the agent is administered within 6, 12, 24, 48, or 100 hours of surgery. The agent can be administered before as well as after surgery.

An exemplary agent is a Tie1 binding agent that includes (a) a heavy chain variable domain sequence that is at least 85, 90, 95, 98, 99%, or 100% identical to the heavy chain variable domain of the E3 antibody and a light chain variable domain sequence that is at least 85, 90, 95, 98, 99%, or 100% identical to the light chain variable domain of the E3 antibody; (b) a heavy chain variable domain sequence and a light chain variable domain sequence that form an antigen binding site that competes with E3 for binding to Tie1; or (c) one, two, or three, of the CDRs of the heavy chain variable domain of the E3 antibody, and one, two, or three of the CDRs of the light chain variable domain of the E3 antibody. Other Tie1 binding agents described herein can also be used, e.g., a Tie1 binding agent that includes a heavy chain variable domain sequence that is at least 85, 90, 95, 98, 99%, or 100% identical to the heavy chain variable domain of M0059A02, M0045A02*, M0054G05, M0053F05, M0053G05, M0061C06, M0045B01, M0046G12, M0046H11, M0053A02, M0053A05, M0046B06, M0044B10, M0044B08, M0056G08, M0045B03, M0053F04, M0055E10, M0060H01, M0054H10, or M0058F03, and a light chain variable domain sequence that is at least 85, 90, 95, 98, 99%, or 100% identical to the light chain variable domain of M0059A02, M0045A02*, M0054G05, M0053F05, M0053G05, M0061C06, M0045B01, M0046G12, M0046H11, M0053A02, M0053A05, M0046B06, M0044B10, M0044B08, M0056G08, M0045B03, M0053F04, M0055E10, M0060H01, M0054H10, or M0058F03.

In another aspect, the invention features a method of treating, e.g., inhibiting, ablating or killing, a cell or impairing at least one activity of the cell. The method includes providing a Tie1-binding protein, e.g. a ligand described herein, and contacting the cell with the protein, in an amount sufficient to impair at least one activity of the cell, inhibit, ablate or kill the cell. The contacting can be in vitro or in vivo. For example, the cell can be, e.g., an endothelial cell, e.g., an endothelial cell in the vicinity of a cancer, e.g., a tumor. The protein can include a cytotoxic entity. Methods of administering a Tie1 binding protein or other agent described herein can be used, for example, to treat or prevent a disorder, e.g., a endothelial cell-based disorder, a blood vessel disorder, wound healing, or a cancerous disorder (e.g., a malignant or metastatic disorder), by administering to a subject (e.g., an experimental animal or a human patient) a Tie1-binding protein in an amount effective to treat or prevent such disorder.

A Tie1 binding protein or other agent described herein can be used on cells in culture, e.g. in vitro or ex vivo. For example, an endothelial cell, e.g., an endothelial cell in cancer biopsy, can be cultured in vitro in culture medium and the contacting step can be effected by adding the Tie1-binding protein to the culture medium. The method can be performed on cells (e.g., cancerous or metastatic cells) present in a subject, as part of an in vivo (e.g., therapeutic or prophylactic) protocol. For in vivo embodiments, the contacting step is effected in a subject and includes administering the Tie1-binding protein to the subject under conditions effective to permit both binding of the protein to the cell, and the inhibition of adhesion, migration, growth or proliferation of the cell.

A Tie1 binding protein or other agent described herein can be used to treat or prevent cancerous disorders, e.g., including hematopoietic cancers, solid tumors, soft tissue tumors, and metastatic lesions, particularly tumors that require a blood supply or angiogenesis. Examples of solid tumors include malignancies, e.g., sarcomas, adenocarcinomas, and carcinomas, of the various organ systems, such as those affecting lung, breast, lymphoid, gastrointestinal (e.g., colon), and genitourinary tract (e.g., renal, urothelial cells), pharynx, as well as adenocarcinomas which include malignancies such as most colon cancers, rectal cancer, renal-cell carcinoma, liver cancer, non-small cell carcinoma of the lung, cancer of the small intestine and cancer of the esophagus. The subject can be a mammal, e.g., a primate, preferably a higher primate, e.g., a human (e.g., a patient having, or at risk of, a disorder described herein, e.g., an endothelial cell-based disorder, e.g., cancer).

The Tie1-binding antibody or fragment thereof, e.g., a Tie1-binding antibody or fragment thereof as described herein, can be administered to the subject systemically (e.g., orally, parenterally, subcutaneously, intravenously, intramuscularly, intraperitoneally, intranasally, transdermally, or by inhalation), topically, or by application to mucous membranes, such as the nose, throat and bronchial tubes.

The methods can further include the step of monitoring the subject, e.g., for a reduction in one or more of: a reduction in tumor size; reduction in cancer markers, e.g., levels of cancer specific antigen; reduction in the appearance of new lesions, e.g., in a bone scan; a reduction in the appearance of new disease-related symptoms; or decreased or stabilization of size of soft tissue mass; or any parameter related to improvement in clinical outcome. The subject can be monitored in one or more of the following periods: prior to beginning of treatment; during the treatment; or after one or more elements of the treatment have been administered. Monitoring can be used to evaluate the need for further treatment with the same Tie1-binding protein or for additional treatment with additional agents. Generally, a decrease in one or more of the parameters described above is indicative of the improved condition of the subject. Information about the monitoring can be recorded, e.g., in electronic or digital form.

The Tie1-binding protein can be used alone in unconjugated form to thereby inhibit adhesion, migration, or extravasation or the Tie1-expressing cells, or ablate or kill the Tie1-expressing cells. If the Tie1-binding protein is an antibody, the ablation or killing can be mediated, e.g., by an antibody-dependent cell killing mechanisms such as complement-mediated cell lysis and/or effector cell-mediated cell killing. In other embodiments, the Tie1-binding protein can be bound (e.g., physically associated, either directly or indirectly, covalently or non-covalently) to a substance, e.g., a cytotoxic agent or moiety, effective to kill or ablate the Tie1-expressing cells. For example, the Tie1-binding protein can be coupled to a radioactive ion (e.g., an $\alpha$-, $\gamma$-, or $\beta$-emitter), e.g., iodine ($^{131}$I or $^{125}$I), yttrium ($^{90}$Y), lutetium ($^{177}$Lu), actinium ($^{225}$Ac), or bismuth ($^{212}$Bi or $^{213}$Bi).

The methods and compositions described herein can be used in combination with other therapeutic modalities. In one embodiment, the methods include administering to the subject a Tie1-binding protein, e.g., a Tie1-binding antibody or fragment thereof, in combination with a cytotoxic agent, in an amount effective to treat or prevent the disorder. The Tie1-binding protein and the cytotoxic agent can be administered simultaneously or sequentially. In other embodiments, a Tie1 binding protein or other agent described herein is used in combination with surgical and/or radiation procedures.

In another aspect, the invention features methods for detecting the presence of a Tie1 protein or a cell expressing Tie1 (e.g., an endothelial cell) in a sample, in vitro (e.g., a biological sample, a tissue biopsy, e.g., a cancerous lesion). The subject method can be used to evaluate, e.g., diagnose or stage a disorder described herein, e.g., a cancerous disorder. The method includes: (i) contacting the sample (and optionally, a reference, e.g., control sample) with a Tie1-binding protein, as described herein, under conditions that allow interaction of the Tie 1-binding protein and the Tie1 protein to occur; and (ii) detecting formation of a complex between the Tie1-binding protein, and the sample (and optionally, the reference, e.g., control, sample). Formation of the complex is indicative of the presence of Tie1 protein (e.g., activated Tie1 protein), and can indicate the suitability or need for a treatment described herein. For example, a statistically significant change in the formation of the complex in the sample relative to the reference sample, e.g., the control sample, is indicative of the presence of Tie1 (e.g., activated Tie1) in the sample.

In yet another aspect, the invention provides a method for detecting the presence of Tie1 (e.g., activated Tie1) in vivo (e.g., in vivo imaging in a subject). The subject method can be used to evaluate, e.g., diagnose, localize, or stage a disorder described herein, e.g., a cancerous disorder. The method includes: (i) administering to a subject (and optionally a control subject) a Tie1-binding protein (e.g., an antibody or antigen binding fragment thereof), under conditions that allow interaction of the Tie1-binding protein and the Tie1 protein to occur; and (ii) detecting formation of a complex between the Tie1-binding protein and Tie1, wherein a statistically significant change in the formation of the complex in the subject relative to the reference, e.g., the control subject or subject's baseline, is indicative of the presence of the Tie1. The presence of Tie1 in particular locations within a subject can be indicative of an endothelial-cell related disorder, e.g., an angiogenesis-related disorder, e.g., a cancer, e.g., metastatic cancer, or other angiogenesis-related disorder described herein.

Tumor cells can express Tie1. In one aspect, the invention features a method of providing a sample from a subject and evaluating the Tie1 expression in cells in the sample. In one embodiment, the result of evaluating Tie1 expression levels is compared to a reference, e.g., a reference value or reference quality. For example, the Tie1 expression on the evaluated sample may have the same, less than, or greater than the reference value. A reference value or quality can be determined using a control sample, a statistical value (e.g., an average, median, etc.) or an arbitrary value. For example, the control sample can be a normal sample, e.g., a sample devoid of tumor cells from the same or different subject. A change (e.g., an increase) relative to the reference can indicate that the sample includes tumor cells, e.g., the subject may be indicated as having a tumor.

In other embodiments, a method of diagnosing or staging a disorder as described herein (e.g., an inflammatory or cancerous disorder), is provided. The method includes: (i) identifying a subject having, or at risk of having, the disorder; (ii) obtaining a sample of a tissue or cell affected with the disorder; (iii) contacting said sample or a control sample with a Tie 1-binding protein, under conditions that allow interaction of the binding agent and the Tie1 protein to occur, and (iv) detecting formation of a complex. A statistically significant increase in the formation of the complex between the Tie1-binding protein with respect to a reference sample, e.g., a control sample, is indicative of the disorder or the stage of the disorder. For example, the finding of activated Tie1 on tumor cells located in a solid tumor can indicate that the tumor is progressing into a metastatic tumor.

Preferably, the Tie1-binding protein used in the in vivo and in vitro diagnostic methods is directly or indirectly labeled with a detectable substance to facilitate detection of the bound or unbound binding agent. Suitable detectable substances include various enzymes, prosthetic groups, fluorescent materials, luminescent materials and radioactive materials. In one embodiment, the Tie1-binding protein is coupled to a radioactive ion, e.g., indium ($^{111}$In), iodine ($^{131}$I or $^{125}$I), yttrium ($^{90}$Y), actinium ($^{225}$Ac), bismuth ($^{212}$Bi or $^{213}$Bi), sulfur ($^{35}$S), carbon ($^{14}$C), tritium ($^{3}$H), rhodium ($^{188}$Rh), or phosphorous ($^{32}$P). In another embodiment, the Tie1-binding protein is labeled with an NMR contrast agent.

In one aspect, the invention features a method of imaging tumor vasculature, the method includes: providing a protein that binds to Tie1, Tie2, or Ang, e.g., a protein described herein, wherein the protein is physically associated to an imaging agent; administering the protein to a patient, e.g., with a tumor; and imaging the patient, e.g., to detect tumor vasculature.

In one aspect, the invention features a method of treating a subject with a blood born neoplastic disorder, the method includes administering a protein that binds to Tie1, Tie2, or Ang, e.g., a protein described herein, to a subject with a blood born neoplastic disorder (e.g., a proliferative disorder of hematopoietic cells, e.g., leukemia), thereby treating the disorder.

In one aspect, the invention features a method of diagnosing and treating a subject, the method includes evaluating a parameter associated with Tie1, Tie2, or Ang in a subject; and, if the parameter is altered relative to a reference, administering a protein described herein to the subject, thereby treating the subject. In one embodiment, the parameter includes a value indicative of protein or mRNA levels, e.g., in a tissue of a subject. In one embodiment, the reference includes a value determined for a reference subject, e.g., an age/gender matched subject, e.g., a control or normal subject.

In one aspect, the invention features a method of treating a subject, the method includes: administering a protein described herein to a subject that has elevated Tie1, Tie2, or Ang biomolecules or activity relative to a reference. The method can include evaluating the subject, e.g., to determine if the subject has elevated Tie1, Tie2, or Ang biomolecules or activity relative to a reference. In one embodiment, the subject has elevated Tie1 protein or mRNA levels.

The invention also provides polypeptides and nucleic acids that encompass a range of amino acid and nucleic acid sequences, e.g., sequences described herein or sequences related to those described herein. For example, the invention features nucleic acids that encodes each of the polypeptides described herein. The nucleic acid can include the cognate codons or any set of codons that can be translated to produce the respective polypeptide. Such polypeptides include individual subunits of a multi-chain protein, e.g., an antibody that includes a plurality of different polypeptide chains. The nucleic acid may also be a nucleic acid fragment or vector that is not expressed, but includes a sequence encoding at least a part of an immunoglobulin variable region (e.g., including a CDR described herein) or a complement thereof. Such nucleic acids can be used to prepare useful constructs, cells, and proteins. In addition, the invention features a host cell that includes a nucleic acid described herein. The cell can express a protein described herein, e.g., on its surface. The invention also includes are proteins that include an amino acid sequence encoded by a nucleic acid described herein or that hybridize to a nucleic acid described herein.

As used herein, the term "antibody" refers to a protein that includes at least one immunoglobulin variable domain or immunoglobulin variable domain sequence. For example, an antibody can include a heavy (H) chain variable region (abbreviated herein as VH), and a light (L) chain variable region (abbreviated herein as VL). In another example, an antibody includes two heavy (H) chain variable regions and two light (L) chain variable regions. The term "antibody" encompasses antigen-binding fragments of antibodies (e.g., single chain antibodies, Fab fragments, F(ab')$_2$, a Fd fragment, a Fv fragments, and dAb fragments) as well as complete antibodies.

The VH and VL regions can be further subdivided into regions of hypervariability, termed "complementarity determining regions" (CDR), interspersed with regions that are more conserved, termed "framework regions" (FR). The extent of the framework region and CDRs has been precisely defined (see, Kabat, E. A., et al. (1991) *Sequences of Proteins of Immunological Interest, Fifth Edition*, U.S. Department of Health and Human Services, NIH Publication No. 91-3242, and Chothia, C. et al. (1987) *J. Mol. Biol.* 196:901-917). Kabat definitions are used herein. Each VH and VL is typically composed of three CDRs and four FRs, arranged from amino-terminus to carboxy-terminus in the following order: FR1, CDR1, FR2, CDR2, FR3, CDR3, FR4.

An "immunoglobulin domain" refers to a domain from the variable or constant domain of immunoglobulin molecules. Immunoglobulin domains typically contain two β-sheets formed of about seven β-strands, and a conserved disulphide bond (see, e.g., A. F. Williams and A. N. Barclay 1988 *Ann. Rev Immunol.* 6:381-405). The canonical structures of hypervariable loops of an immunoglobulin variable can be inferred from its sequence, as described in Chothia et al. (1992) *J. Mol. Biol.* 227:799-817; Tomlinson et al. (1992) *J. Mol. Biol.* 227:776-798); and Tomlinson et al. (1995) EMBO J. 14(18):4628-38.

As used herein, an "immunoglobulin variable domain sequence" refers to an amino acid sequence which can form the structure of an immunoglobulin variable domain. For example, the sequence may include all or part of the amino acid sequence of a naturally-occurring variable domain. For example, the sequence may omit one, two or more N- or C-terminal amino acids, internal amino acids, may include one or more insertions or additional terminal amino acids, or may include other alterations. In one embodiment, a polypeptide that includes immunoglobulin variable domain sequence can associate with another immunoglobulin variable domain sequence to form a target binding structure (or "antigen binding site"), e.g., a structure that interacts with Tie1, e.g., binds to or inhibits Tie1.

The VH or VL chain of the antibody can further include all or part of a heavy or light chain constant region, to thereby form a heavy or light immunoglobulin chain, respectively. In one embodiment, the antibody is a tetramer of two heavy immunoglobulin chains and two light immunoglobulin chains, wherein the heavy and light immunoglobulin chains are inter-connected by, e.g., disulfide bonds. The heavy chain constant region includes three domains, CH1, CH2 and CH3. The light chain constant region includes a CL domain. The variable region of the heavy and light chains contains a binding domain that interacts with an antigen. The constant regions of the antibodies typically mediate the binding of the antibody to host tissues or factors, including various cells of the immune system (e.g., effector cells) and the first component (Clq) of the classical complement system. The term "antibody" includes intact immunoglobulins of types IgA, IgG, IgE, IgD, IgM (as well as subtypes thereof). The light chains of the immunoglobulin may be of types kappa or lambda. In one embodiment, the antibody is glycosylated. An antibody can be functional for antibody-dependent cytotoxicity and/or complement-mediated cytotoxicity.

One or more regions of an antibody can be human or effectively human. For example, one or more of the variable regions can be human or effectively human. For example, one or more of the CDRs can be human, e.g., HC CDR1, HC CDR2, HC CDR3, LC CDR1, LC CDR2, and LC CDR3. Each of the light chain CDRs can be human. HC CDR3 can be human. One or more of the framework regions can be human, e.g., FR1, FR2, FR3, and FR4 of the HC or LC. In one embodiment, all the framework regions are human, e.g., derived from a human somatic cell, e.g., a hematopoietic cell that produces immunoglobulins or a non-hematopoietic cell. In one embodiment, the human sequences are germline sequences, e.g., encoded by a germline nucleic acid. One or more of the constant regions can be human or effectively human. In another embodiment, at least 70, 75, 80, 85, 90, 92, 95, or 98% of the framework regions (e.g., FR1, FR2, and FR3, collectively, or FR1, FR2, FR3, and FR4, collectively) or the entire antibody can be human or effectively human. For example, FR1, FR2, and FR3 collectively can be at least 70, 75, 80, 85, 90, 92, 95, 98, or 99% identical to a human sequence encoded by a human germline V segment of a locus encoding a light or heavy chain sequence.

All or part of an antibody can be encoded by an immunoglobulin gene or a segment thereof. Exemplary human immunoglobulin genes include the kappa, lambda, alpha (IgA1 and IgA2), gamma (IgG1, IgG2, IgG3, IgG4), delta, epsilon and mu constant region genes, as well as the myriad immunoglobulin variable region genes. Full-length immunoglobulin light chains (about 25 Kd or 214 amino acids) are encoded by a variable region gene at the NH2-terminus (about 110 amino acids) and a kappa or lambda constant region gene at the COOH-terminus. Full-length immunoglobulin heavy chains (about 50 Kd or 446 amino acids), are similarly encoded by a variable region gene (about 116 amino acids) and one of the other aforementioned constant region genes, e.g., gamma (encoding about 330 amino acids). A light chain refers to any polypeptide that includes a light chain variable domain. A heavy chain refers to any polypeptide that a heavy chain variable domain.

The term "antigen-binding fragment" of a full-length antibody (or simply "antibody portion," or "fragment"), as used herein, refers to one or more fragments of a full-length antibody that retain the ability to specifically bind to a target of interest. Examples of binding fragments encompassed within the term "antigen-binding fragment" of a full length antibody include (i) a Fab fragment, a monovalent fragment consisting of the VL, VH, CL and CH1 domains; (ii) a F(ab')$_2$ fragment, a bivalent fragment including two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) *Nature* 341:544-546), which consists of a VH domain; and (vi) an isolated complementarity determining region (CDR) that retains functionality. Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules known as single chain Fv (scFv). See e.g., Bird et al. (1988) *Science* 242:423-426; and Huston et al. (1988) *Proc. Natl. Acad. Sci. USA* 85:5879-5883.

Antibody fragments can be obtained using any appropriate technique including conventional techniques known to those with skill in the art. The term "monospecific antibody" refers to an antibody that displays a single binding specificity and affinity for a particular target, e.g., epitope. This term includes a "monoclonal antibody" or "monoclonal antibody composition," which as used herein refer to a preparation of antibodies or fragments thereof of single molecular composition. As used herein, "isotype" refers to the antibody class (e.g., IgM or IgG1) that is encoded by heavy chain constant region genes.

In one embodiment, the HC or LC of an antibody includes sequences that correspond to an amino acid sequence encoded by a human germline sequence, e.g., the framework regions and/or in the CDRs. For example, the antibody can include sequences from the human DP47 antibody. In one embodiment, one or more codons for the antibody are altered relative to the germline nucleic acid sequence, but are chosen to encode the same amino acid sequence. Codons can be selected, e.g., to optimize expression in a particular system, create restriction enzyme sites, create a silent fingerprint, etc.

In one embodiment, CDR2 of the antibody HC includes at least 11, 12, 13, 14, or 15 amino acid positions that are identical to the amino acids found in CDR2 of DP47.

A "humanized" immunoglobulin variable region is an immunoglobulin variable region that includes sufficient number of human framework amino acid positions such that the immunoglobulin variable region does not elicit an immunogenic response in a normal human. Descriptions of "humanized" immunoglobulins include, for example, U.S. Pat. No. 6,407,213 and U.S. Pat. No. 5,693,762.

An "effectively human" immunoglobulin variable region is an immunoglobulin variable region that includes a sufficient number of human framework amino acid positions such that the immunoglobulin variable region does not elicit an immunogenic response in a normal human. An "effectively human" antibody is an antibody that includes a sufficient number of human amino acid positions such that the antibody does not elicit an immunogenic response in a normal human.

As used herein, "Tie complex" refers to a heteromeric complex that includes Tie1, Tie2, and an angiopoietin (Ang). The Tie complex is formed in part by association of the extracellular domains of Tie1 and Tie2 and also includes Ang. As used herein, "complex members" refers to the proteins that are included in a heteromeric Tie complex. Accordingly, Tie1, Tie2, and Ang are all complex members. The term "Ang" includes all angiopoietins, such as Ang1, Ang2, Ang3, and Ang4. The heteromeric Tie complex can include other proteins in addition to Tie1, Tie2, and Ang. A protein or ligand that antagonizes complex formation inhibits or decreases the association of Tie1, Tie2, or Ang with at least one other member of the complex and thereby decreases Tie2 signaling and downstream effects such as angiogenesis. Angiogenesis includes all stages of vessel development (e.g., blood or lymphatic vessel development), including initial vessel formation and later vessel remodeling and morphological changes.

As used herein, the terms "agonist" and "antagonist" describe properties in context of a particular activity or effect. For example, the E3 or E3b antibody can be an agonist in the context of promoting Tie1 self-association (e.g., homodimerization), yet an antagonist in the context of decreasing or inhibiting Tie complex formation and tube formation by HUVECs. Likewise, an agent that is an agonist in the context of a Tie1 signaling pathway can be an antagonist in the context of endothelial cell sprouting, splitting, and tube formation.

The term "Tie1 ectodomain" refers to an extracellular region of a Tie1 protein, e.g., a region that includes about amino acids 25-759 of SEQ ID NO:2. Other exemplary regions are regions that include one or more EGF-like domains (e.g., 214-256, 258-303, 303-345, 214-303, 258-345, or 214-345 of SEQ ID NO:2); one or more Ig-Like C2-type domains (e.g., 43-105, 43-426, 372-426); one or more Fibronectin Type III repeats (e.g., 446-540, 543-639, 643-744, 446-639, 543-744, or 446-744 of SEQ ID NO:2); and combinations thereof. The terms "first Ig-like C2-type domain" and "Ig 1" refer to the immunoglobulin-like domain in Tie1 or Tie2 that is located closest to the amino terminus of the protein relative to the other Ig-like C2-type domain (the second such domain). For example, for Tie1, the first Immunoglobulin-like C2-type domain is located at about residue 43 to about residue 105 and the second Ig-like C2-type domain is located at about residue 372 to about residue 426.

As used herein, "binding affinity" refers to the apparent association constant or $K_a$. The $K_a$ is the reciprocal of the dissociation constant ($K_d$). A ligand may, for example, have a binding affinity of at least $10^5$, $10^6$, $10^7$ or $10^8$ $M^{-1}$ for a particular target molecule. Higher affinity binding of a ligand to a first target relative to a second target can be indicated by a higher $K_a$ (or a smaller numerical value $K_d$) for binding the first target than the $K_a$ (or numerical value $K_d$) for binding the second target. In such cases the ligand has specificity for the first target relative to the second target. Differences in binding affinity (e.g., for specificity or other comparisons) can be at least 1.5, 2, 5, 10, 50, 100, or 1000-fold. For example, a Tie1-binding protein may preferentially bind to Tie1 at least 1.5, 2, 5, 10, 50, 100, or 1000-fold better than to another antigen, e.g., Tie2, EGF, fibronectin, or human serum albumin. A Tie1-binding protein may also be species-specific or species-general (e.g., can bind to a Tie1 protein from more than one species).

Binding affinity can be determined by a variety of methods including equilibrium dialysis, equilibrium binding, gel filtration, ELISA, surface plasmon resonance, or spectroscopy (e.g., using a fluorescence assay). These techniques can be used to measure the concentration of bound and free ligand as a function of ligand (or target) concentration. The concentration of bound ligand ([Bound]) is related to the concentration of free ligand ([Free]) and the concentration of binding sites for the ligand on the target where (N) is the number of binding sites per target molecule by the following equation:

$$[Bound] = N \cdot [Free]/((1/Ka) + [Free])$$

Although quantitative measurements of Ka are routine, it is not always necessary to make an exact determination of $K_a$, though, since sometimes it is sufficient to obtain a qualitative measurement of affinity, e.g., determined using a method such as ELISA or FACS analysis, is proportional to $K_a$, and thus can be used for comparisons, such as determining whether a higher affinity is, e.g., 2, 5, 10, 20, or 50 fold higher than a reference. Binding affinity is typically evaluated in 0.01 M HEPES pH 7.4, 0.15 M NaCl, 3 mM EDTA and 0.005% (v/v) surfactant P20.

An "isolated composition" refers to a composition that is removed from at least 90% of at least one component of a natural sample from which the isolated composition can be obtained. Compositions produced artificially or naturally can be "compositions of at least" a certain degree of purity if the species or population of species of interests is at least 5, 10, 25, 50, 75, 80, 90, 95, 98, or 99% pure on a weight-weight basis.

An "epitope" refers to the site on a target compound that is bound by a ligand, e.g., an antigen-binding protein (e.g., a Fab or antibody). In the case where the target compound is a protein, for example, an epitope may refer to the amino acids that are bound by the ligand. Overlapping epitopes include at least one common amino acid residue.

As used herein, the term "substantially identical" (or "substantially homologous") is used herein to refer to a first amino acid or nucleotide sequence that contains a sufficient number of identical or equivalent (e.g., with a similar side chain, e.g., conserved amino acid substitutions) amino acid residues or nucleotides to a second amino acid or nucleotide sequence such that the first and second amino acid or nucleotide sequences have similar activities. In the case of antibodies, the second antibody has the same specificity and has at least 50% of the affinity of the same.

Sequences similar or homologous (e.g., at least about 85% sequence identity) to the sequences disclosed herein are also part of this application. In some embodiment, the sequence identity can be about 85%, 90%, 91%, 92%, 93%, 94%, 95%, 96%, 97%, 98%, 99% or higher. Alternatively, substantial identity exists when the nucleic acid segments will hybridize under selective hybridization conditions (e.g., highly stringent hybridization conditions), to the complement of the strand. The nucleic acids may be present in whole cells, in a cell lysate, or in a partially purified or substantially pure form.

Calculations of "homology" or "sequence identity" between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence aligned for comparison purposes is at least 30%, preferably at least 40%, more preferably at least 50%, even more preferably at least 60%, and even more preferably at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In a preferred embodiment, the percent identity between two amino acid sequences is determined using the Needleman and Wunsch ((1970) *J. Mol. Biol.* 48:444-453) algorithm which has been incorporated into the GAP program in the GCG software package, using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package, using a NWSgapdna.CMP matrix and a gap weight of 40, 50, 60, 70, or 80 and a length weight of 1, 2, 3, 4, 5, or 6. A particularly preferred set of parameters (and the one that should be used if the practitioner is uncertain about what parameters should be applied to determine if a molecule is within a sequence identity or homology limitation described herein) are a Blossum 62 scoring matrix with a gap penalty of 12, a gap extend penalty of 4, and a frameshift gap penalty of 5.

As used herein, the term "homologous" is synonymous with "similarity" and means that a sequence of interest differs from a reference sequence by the presence of one or more amino acid substitutions (although modest amino acid insertions or deletions) may also be present. Presently preferred means of calculating degrees of homology or similarity to a reference sequence are through the use of BLAST algorithms (available from the National Center of Biotechnology Information (NCBI), National Institutes of Health, Bethesda Md.), in each case, using the algorithm default or recommended parameters for determining significance of calculated sequence relatedness. The percent identity between two amino acid or nucleotide sequences can also be determined using the algorithm of E. Meyers and W. Miller ((1989) *CABIOS*, 4:11-17) which has been incorporated into the ALIGN program (version 2.0), using a PAM120 weight residue table, a gap length penalty of 12 and a gap penalty of 4.

As used herein, the term "hybridizes under low stringency, medium stringency, high stringency, or very high stringency conditions" describes conditions for hybridization and washing. Guidance for performing hybridization reactions can be found in *Current Protocols in Molecular Biology*, John Wiley & Sons, N.Y. (1989), 6.3.1-6.3.6. Aqueous and nonaqueous methods are described in that reference and either can be used. Specific hybridization conditions referred to herein are as follows: 1) low stringency hybridization conditions in 6× sodium chloride/sodium citrate (SSC) at about 45° C., followed by two washes in 0.2× SSC, 0.1% SDS at least at 50° C. (the temperature of the washes can be increased to 55° C. for low stringency conditions); 2) medium stringency hybridization conditions in 6× SSC at about 45° C., followed by one or more washes in 0.2× SSC, 0.1% SDS at 60° C.; 3) high stringency hybridization conditions in 6× SSC at about 45° C., followed by one or more washes in 0.2× SSC, 0.1% SDS at 65° C.; and 4) very high stringency hybridization conditions are 0.5M sodium phosphate, 7% SDS at 65° C., followed by one or more washes at 0.2× SSC, 1% SDS at 65° C.

It is understood that the proteins described herein may have mutations relative to a particular protein described herein (e.g., a conservative or non-essential amino acid substitutions), which do not have a substantial effect on function. Whether or not a particular substitution will be tolerated, i.e., will not adversely affect desired biological properties, such as binding activity can be determined as described in Bowie, et al. (1990) *Science* 247:1306-1310. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). It is possible, for example, for framework and CDR amino acid residues to include one or more conservative substitutions.

A "non-essential" amino acid residue is a residue that can be altered from the wild-type sequence of the binding agent, e.g., the antibody, without abolishing or more preferably, without substantially altering a biological activity, whereas an "essential" amino acid residue results in such a change.

Generally, where "X" is used to represent an amino acid residue, any amino acid (e.g., any of the twenty naturally occurring amino acids) can be used at that position, or at least a subset thereof (e.g., any of the nineteen non-cysteine amino acids).

The terms "polypeptide" or "peptide" (which may be used interchangeably) refer to a polymer of three or more amino acids linked by a peptide bond, e.g., between 3 and 30, 12 and 60, or 30 and 300, or over 300 amino acids in length. The polypeptide may include one or more unnatural amino acids. Typically, the polypeptide includes only natural amino acids. A "protein" can include one or more polypeptide chains. Accordingly, the term "protein" encompasses polypeptides. A protein or polypeptide can also include one or more modifications, e.g., a glycosylation, amidation, phosphorylation, and so forth. The term "small peptide" can be used to describe a polypeptide that is between 3 and 30 amino acids in length, e.g., between 8 and 24 amino acids in length.

Statistical significance can be determined by any art known method. Exemplary statistical tests include: the Students T-test, Mann Whitney U non-parametric test, and Wilcoxon non-parametric statistical test. Some statistically significant relationships have a P value of less than 0.05, or 0.02. Particular ligands may show a difference, e.g., in specificity or binding, that are statistically significant (e.g., P value<0.05 or 0.02).

Other features and advantages of the instant invention will become more apparent from the following detailed description and claims. Embodiments of the invention can include any combination of features described herein. In no case does the term "embodiment" necessarily exclude one or more other features disclosed herein, e.g., in another embodiment. The contents of all references, patent applications and patents, cited throughout this application are hereby expressly incorporated by reference.

BRIEF DESCRIPTION OF THE FIGURES

FIGS. 7A and 7B list the amino acid sequence of the heavy chain variable domain and the light chain variable domain of clone p-A1, respectively.

FIGS. 8A and 8B list the amino acid sequence of the heavy chain variable domain and the light chain variable domain of clone p-A5, respectively.

FIGS. 9A and 9B list the amino acid sequence of the heavy chain variable domain and the light chain variable domain of clone p-A6, respectively.

FIGS. 10A and 10B list the amino acid sequence of the heavy chain variable domain and the light chain variable domain of clone p-A10, respectively.

FIGS. 11A and 11B list the amino acid sequence of the heavy chain variable domain and the light chain variable domain of clone p-B1, respectively.

FIGS. 12A and 12B list the amino acid sequence of the heavy chain variable domain and the light chain variable domain of clone p-B3, respectively.

FIGS. 13A and 13B list the amino acid sequence of the heavy chain variable domain and the light chain variable domain of clone p-C6, respectively.

FIGS. 14A and 14B list the amino acid sequence of the heavy chain variable domain and the light chain variable domain of clone p-D6, respectively.

FIGS. 15A and 15B list the amino acid sequence of the heavy chain variable domain and the light chain variable domain of clone p-D10, respectively.

FIGS. 16A and 16B list the amino acid sequence of the heavy chain variable domain and the light chain variable domain of clone p-D12, respectively.

FIGS. 17A and 17B list the amino acid sequence of the heavy chain variable domain and the light chain variable domain of clone p-F3, respectively.

FIGS. 18A and 18B list the amino acid sequence of the heavy chain variable domain and the light chain variable domain of clone p-F4, respectively.

FIGS. 19A and 19B list the amino acid sequence of the heavy chain variable domain and the light chain variable domain of clone p-G3, respectively.

FIGS. 20A and 20B list the amino acid sequence of the heavy chain variable domain and the light chain variable domain of clone s-A2, respectively.

FIGS. 21A and 21B list the amino acid sequence of the heavy chain variable domain and the light chain variable domain of clone s-A10, respectively.

FIGS. 22A and 22B list the amino acid sequence of the heavy chain variable domain and the light chain variable domain of clone s-B2, respectively.

FIGS. 23A and 23B list the amino acid sequence of the heavy chain variable domain and the light chain variable domain of clone s-B9, respectively.

FIGS. 24A and 24B list the amino acid sequence of the heavy chain variable domain and the light chain variable domain of clone s-C2, respectively.

FIGS. 25A and 25B list the amino acid sequence of the heavy chain variable domain and the light chain variable domain of clone s-C7, respectively.

FIGS. 26A and 26B list the amino acid sequence of the heavy chain variable domain and the light chain variable domain of clone s-C10, respectively.

FIGS. 27A and 27B list the amino acid sequence of the heavy chain variable domain and the light chain variable domain of clone s-D11, respectively.

FIGS. 28A and 28B list the amino acid sequence of the heavy chain variable domain and the light chain variable domain of clone s-E11, respectively.

FIGS. 29A and 29B list the amino acid sequence of the heavy chain variable domain and the light chain variable domain of clone s-G4, respectively.

FIG. 30 lists the amino acid sequence of the light chain variable domain of clone s-G9.

FIGS. 31A and 31B list the amino acid sequence of the heavy chain variable domain and the light chain variable domain of clone s-G10, respectively.

FIGS. 32A and 32B list the amino acid sequence of the heavy chain variable domain and the light chain variable domain of clone s-H1, respectively.

FIGS. 33A and 33B list the amino acid sequence of the heavy chain variable domain and the light chain variable domain of clone s-H4, respectively.

FIGS. 34A and 34B list the amino acid sequence of the heavy chain variable domain and the light chain variable domain of clone G2, respectively.

FIGS. 35 and 36 list the amino acid sequence of the heavy chain variable domain and the light chain variable domain of clone p-A1, respectively.

FIG. 37 provides Table 5, a summary of heavy chain sequences.

FIG. 38 provides Table 6, a summary of light chain sequences.

FIG. 39 provides Table 9, characteristics of some exemplary Tie1 binding antibodies.

DETAILED DESCRIPTION

Figure 1:
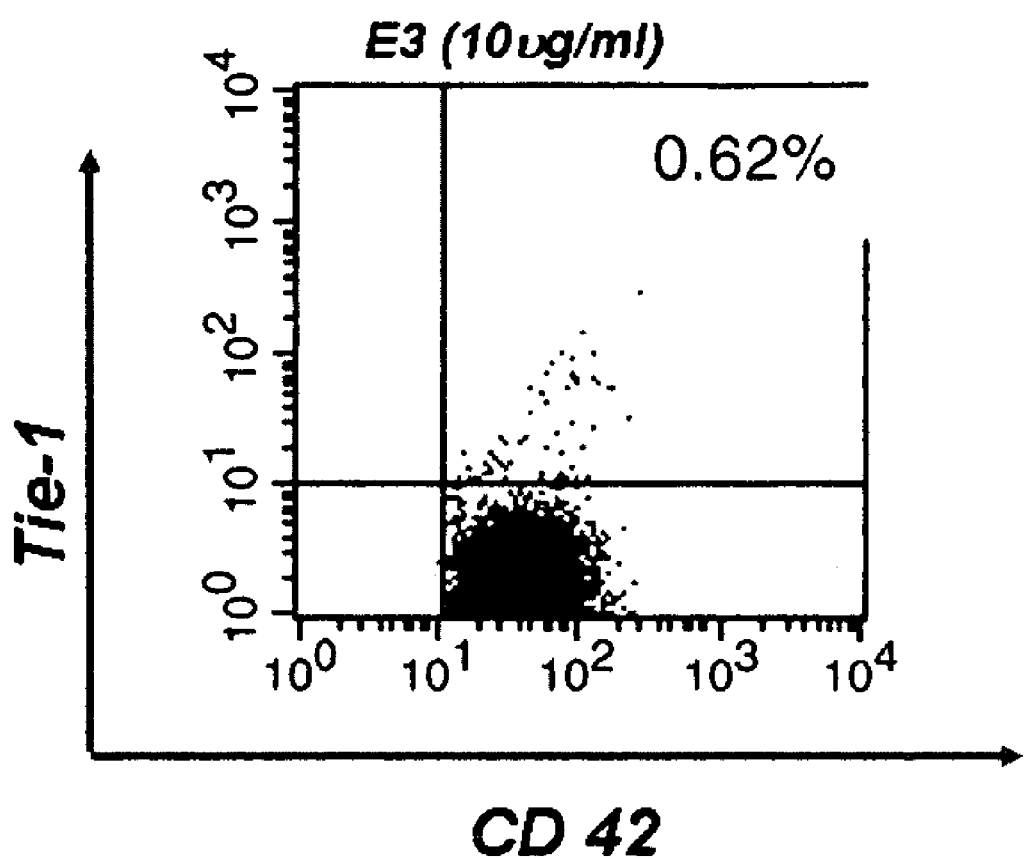
FIG. 1 illustrates a bivariant FACS plot showing labelling with the platelet specific marker CD42 with Tie1 and labelling with the E3 antibody. Only a background number of CD42 positive cells are labeled by the E3 antibody.

This disclosure provides, inter alia, agents (also referred to as binding proteins and ligands) that bind to components of a Tie complex, e.g., Tie1, Tie2, and Ang. Examples of such agents include proteins, for example, a small peptide (e.g., a cyclic or linear peptide, e.g., of between 7 and 25 amino acids), a polypeptide (e.g., a polypeptide of at least 20 amino acids), or a multi-chain protein (e.g., including at least two peptides or polypeptides). An example of a multi-chain protein is an IgG full-length antibody that has separate heavy and light chains. An example of a polypeptide is a single chain antibody.

Agents can be selected that have particular properties, e.g., ability to antagonize Tie1/Tie2/Ang complex formation, ability to promote Tie1 homodimerization, and ability to promote Tie1 phosphorylation. For example, agents that bind to Tie1, Tie2, or Ang can be tested for their ability to antagonize formation of heteromeric Tie complexes. Antagonism of this complex decreases Tie2 signaling and its downstream effects, such as promoting angiogenesis.

Tie1 is a receptor tyrosine kinase protein that includes a transmembrane domain. Tie1 is present almost exclusively on endothelial cells. Accordingly, a Tie1-binding protein can be used, e.g., to specifically recognize or target an endothelial cell. Some Tie1-binding proteins can also be used to agonize or antagonize endothelial cells. In some embodiments, these Tie1-binding proteins have an affinity for particular structural features (e.g., a feature listed below), a combination of features listed below, and/or an epitope that includes at least one amino acid in a structural feature listed below (The sequence is relative to the amino acid sequence provided in SEQ ID NO:2, Example 1, below):

| Key | From | To | Length | Description |
|---|---|---|---|---|
| SIGNAL | 1 | 24 | 24 | POTENTIAL. |
| CHAIN | 25 | 1138 | 1114 | TYROSINE-PROTEIN KINASE RECEPTOR TIE1. |
| DOMAIN | 25 | 759 | 735 | EXTRACELLULAR (POTENTIAL). |
| TRANSMEM | 760 | 784 | 25 | POTENTIAL. |
| DOMAIN | 785 | 1138 | 354 | CYTOPLASMIC (POTENTIAL). |
| DOMAIN | 43 | 105 | 63 | IG-LIKE C2-TYPE 1. |

-continued

| Key | From | To | Length | Description |
| --- | --- | --- | --- | --- |
| DOMAIN | 214 | 256 | 43 | EGF-LIKE 1. |
| DOMAIN | 258 | 303 | 46 | EGF-LIKE 2. |
| DOMAIN | 305 | 345 | 41 | EGF-LIKE 3. |
| DOMAIN | 372 | 426 | 55 | IG-LIKE C2-TYPE 2. |
| DOMAIN | 446 | 540 | 95 | FIBRONECTIN TYPE-III 1. |
| DOMAIN | 543 | 639 | 97 | FIBRONECTIN TYPE-III 2. |
| DOMAIN | 643 | 744 | 102 | FIBRONECTIN TYPE-III 3. |
| DOMAIN | 839 | 1118 | 280 | PROTEIN KINASE. |
| NP_BIND | 845 | 853 | 9 | ATP (BY SIMILARITY). |
| BINDING | 870 | 870 | | ATP (BY SIMILARITY). |
| ACT_SITE | 979 | 979 | | BY SIMILARITY. |
| CARBOHYD | 83 | 83 | | N-LINKED (GLCNAC . . . ) (POTENTIAL). |
| CARBOHYD | 161 | 161 | | N-LINKED (GLCNAC . . . ) (POTENTIAL). |
| CARBOHYD | 503 | 503 | | N-LINKED (GLCNAC . . . ) (POTENTIAL). |
| CARBOHYD | 596 | 596 | | N-LINKED (GLCNAC . . . ) (POTENTIAL). |
| CARBOHYD | 709 | 709 | | N-LINKED (GLCNAC . . . ) (POTENTIAL). |
| MOD_RES | 1007 | 1007 | | PHOSPHORYLATION (AUTO-) (BY SIMILARITY). | domain. Tie2 is present almost exclusively on endothelial cells. Accordingly, a Tie2-binding protein can be used, e.g., to specifically recognize or target an endothelial cell. Some Tie2-binding proteins can also be used to modulate (e.g., agonize or antagonize) an activity of an endothelial cell. In some embodiments, these Tie2-binding proteins have an affinity for particular structural features, a combination of features, and/or an epitope that includes at least one amino acid in a structural feature. Exemplary structural features of Tie2 include: two Ig-like domains, three EGF-like domains, and three fibronectin type III domains.

The angiopoietins are a family of ligands that bind to Tie2. Some Ang-binding proteins (e.g., antibodies or artificial Ang-binding proteins) can be used to agonize or antagonize endothelial cells. In some embodiments, these Ang-binding proteins have an affinity for particular structural features, a combination of features, and/or an epitope that includes at least one amino acid in a structural feature. Exemplary structural features include: the N-terminal region of about 50 amino acids, the coiled-coil domain, or the fibrinogen-like domain.

Examples of Ang-binding proteins include proteins that inhibit Ang multimerization (e.g., ability of Ang proteins to form tetramers), proteins that inhibit Ang-Tie2 interactions, and proteins that inhibit a ternary complex of Tie1-Tie2-Ang. Inhibitory proteins can function by disrupting existing interactions or by preventing interactions from occurring.

Tie1 and Tie2 can associate through their extracellular domains and form a heteromeric complex with an angiopoietin (Ang), such as Ang1, Ang2, Ang3, and Ang4. This heteromeric complex activates the intracellular signaling cascade mediated by Tie2. Thus, antagonizing formation of this heteromeric complex provides a novel approach to inhibiting Tie2 signaling and its downstream effects, such as angiogenesis. Complex formation can be antagonized by proteins that bind to the extracellular domains of Tie1 or Tie2 or that bind to Ang so as to prevent its recruitment into the complex or to prevent its multimerization.

One method for identifying proteins that bind to Tie1 includes: providing a library and selecting from the library one or more members that encode a protein that binds to the Tie1 antigen or a fragment thereof (e.g., the extracellular domain, an EGF domain, a fibronectin repeat, or an Ig-superfamily domain (e.g., a Ig-like C2-type 2 domain)). The selection can be performed in a number of ways. For example, the library can be a display library. The Tie1 can be tagged and recombinantly expressed. The Tie1 is purified and attached to a support, e.g., to affinity beads, or paramagnetic beads or other magnetically responsive particles. The Tie1 can also be expressed on the surface of a cell. Members of the display library that specifically bind to the cell, e.g., only if the Tie1 is activated, can be selected. Analogous procedures can be performed to identify proteins that bind to Tie2 or a fragment thereof (e.g., the extracellular domain, an EGF domain, a fibronectin repeat, or an Ig-superfamily domain (e.g., a Ig-like C2-type 2 domain)). Analogous procedures can also be performed to identify proteins that bind to Ang or a fragment thereof (e.g., the N-terminal domain, the coiled-coil domain, or the fibrinogen-like domain).

Proteins identified as being capable of binding a Tie complex member can be tested for their ability to antagonize heteromeric complex formation, ability to promote Tie1 phosphorylatoin, and/or ability to promote Tie1 homodimerization, as described in the examples below. Proteins identified as antagonizing formation of the heteromeric complex can be used in pharmaceutical compositions to treat a subject in need of such treatment, for example, a subject with an angiogenesis-dependent cancer or tumor or other angiogenesis-related disorders.

Exemplary Tie1 Modulators

In one embodiment, a Tie1-binding protein can modulate a Tie1 activity. For example, a Tie1-binding protein can function as a Tie1 agonist or antagonist in the Tie1/EpoR chimeric BaF3 cell assay described in Example 2. Tie1 agonists in this Tie1/EpoR chimeric BaF3 cell assay can stimulate certain activity of an endothelial cell under particular conditions, e.g., the conditions of the Tie1/EpoR chimeric BaF3 cell assay.

Some Tie1 binding proteins increase phosphatidyl inositol 3-kinase (PI3 kinase) activity in an endothelial cell and/or Akt kinase activity. Kontos et al. suggest that the cytoplasmic domain of Tie1 can associate with the p85 subunit of PI3 kinase and activate PI3 kinase activity. Kontos et al. (2002) *Mol. Cell Biol.* 22:1704-1713. The Tie1 cytoplasmic domain may also associate with a protein tyrosine phosphatase Shp2. See, e.g., Marron et al. (2000) *Adv. Exp. Med. Biol.* 476:35-46.

Some Tie binding proteins may increase dimerization, and/or tyrosine phosphorylation (e.g., as a result of auto-phosphorylation) of the Tie1 cytoplasmic domain, e.g., the tyrosine in the motif YVN at about amino acid 1117.

Tie1-binding protein can be evaluated in a cell assay (e.g., in the Tie1/EpoR chimeric BaF3 cell assay as described below in Example 2). An exemplary cell assay uses a growth factor dependent cell in which a chimeric receptor that includes the Tie1 ectodomain fused to the intracellular domain of the growth factor receptor is expressed. Cells are evaluated for ability to grow in the absence of the essential growth factor, but in the presence of a test compound, e.g., a Tie1-binding protein. If the Tie1-binding protein agonizes Tie1 in the Tie1/EpoR chimeric BaF3 cell assay, a signalling activity of the Tie1 chimera can substitute for stimulation by the required growth factor thorough its cognate receptor. Thus, survival of the cell in the absence of the required growth factor can be used as an indication that the Tie1-binding protein interacts with the Tie1 ectodomain.

Tie1 agonists in the Tie1/EpoR chimeric BaF3 cell assay may behave as inhibitors of Tie1 activity under other conditions, e.g., in vivo, and, irrespective of in vitro properties, may be useful as inhibitors of angiogenesis in vivo.

Tie1 binding proteins can be used, e.g., to reduce an activity of an endothelial cell. For example, some Tie1 binding proteins can be used to decrease phosphatidyl inositol 3-kinase (PI3 kinase) activity in an endothelial cell, Shp2 activity, and/or Akt kinase activity. Some Tie1 binding proteins may also reduce dimerization, and/or tyrosine phosphorylation (e.g., as a result of auto-phosphorylation) of the Tie1 cytoplasmic domain, e.g., the tyrosine in the motif YVN at about amino acid 1117.

Tie1-binding protein can be evaluated for activity in a cell assay. For example, the binding protein can be assayed for ability to prevent another ligand, e.g., the E3 antibody, from modulating a Tie1 activity in a cell assay described herein (e.g., the Tie1/EpoR chimeric BaF3 cell assay as described below in Example 2).

Display Libraries

A number of methods can be used to identify proteins that bind to Tie1, Tie2, Ang, fragments thereof, complexes that include one or more of these proteins or fragments thereof. In one embodiment, a display library is used to identify such proteins. A display library is a collection of entities; each entity includes an accessible protein component and a recoverable component that encodes or identifies the protein component. The protein component can be of any length, e.g. from three amino acids to over 300 amino acids. In a selection, the protein component of each member of the library is probed with a target, e.g., Tie1 protein, and if the protein component binds to the target, the display library member is identified, e.g., by retention on a support. The method can be adapted for other targets, such as Tie2, Ang, fragments thereof, complexes that include one or more of these proteins or fragments thereof.

Retained display library members are recovered from the support and analyzed. The analysis can include amplification and a subsequent selection under similar or dissimilar conditions. For example, positive and negative selections can be alternated. The analysis can also include determining the amino acid sequence of the protein component and purification of the protein component for detailed characterization. A variety of formats can be used for display libraries. Examples include the following.

Phage Display. One format utilizes viruses, particularly bacteriophages. This format is termed "phage display." The protein component is typically covalently linked to a bacteriophage coat protein. The linkage results form translation of a nucleic acid encoding the protein component fused to the coat protein. The linkage can include a flexible peptide linker, a protease site, or an amino acid incorporated as a result of suppression of a stop codon. Phage display is described, for example, in Ladner et al., U.S. Pat. No. 5,223,409; Smith (1985) *Science* 228:1315-1317; WO 92/18619; WO 91/17271; WO 92/20791; WO 92/15679; WO 93/01288; WO 92/01047; WO 92/09690; WO 90/02809; de Haard et al. (1999) *J. Biol. Chem* 274:18218-30; Hoogenboom et al. (1998) *Immunotechnology* 4:1-20; Hoogenboom et al. (2000) *Immunol Today* 2:371-8; Fuchs et al. (1991) *Bio/Technology* 9:1370-1372; Hay et al. (1992) *Hum Antibod Hybridomas* 3:81-85; Huse et al. (1989) *Science* 246:1275-1281; Griffiths et al. (1993) *EMBO J.* 12:725-734; Hawkins et al. (1992) *J Mol Biol* 226:889-896; Clackson et al. (1991) *Nature* 352: 624-628; Gram et al. (1992) *PNAS* 89:3576-3580; Garrard et al. (1991) *Bio/Technology* 9:1373-1377; Rebar et al. (1996) *Methods Enzymol.* 267:129-49; Hoogenboom et al. (1991) *Nuc Acid Res* 19:4133-4137; and Barbas et al. (1991) *PNAS* 88:7978-7982.

Phage display systems have been developed for filamentous phage (phage fl, fd, and M13) as well as other bacteriophage (e.g. T7 bacteriophage and lambdoid phages; see, e.g., Santini (1998) *J. Mol. Biol.* 282:125-135; Rosenberg et al. (1996) *Innovations* 6:1-6; Houshmet al. (1999) *Anal Biochem* 268:363-370). The filamentous phage display systems typically use fusions to a minor coat protein, such as gene III protein, and gene VIII protein, a major coat protein, but fusions to other coat proteins such as gene VI protein, gene VII protein, gene IX protein, or domains thereof can also been used (see, e.g., WO 00/71694). In one embodiment, the fusion is to a domain of the gene III protein, e.g., the anchor domain or "stump," (see, e.g., U.S. Pat. No. 5,658,727 for a description of the gene III protein anchor domain). It is also possible to physically associate the protein being displayed to the coat using a non-peptide linkage, e.g., a non-covalent bond or a non-peptide covalent bond. For example, a disulfide bond and/or c-fos and c-jun coiled-coils can be used for physical associations (see, e.g., Crameri et al. (1993) *Gene* 137:69 and WO 01/05950).

Bacteriophage displaying the protein component can be grown and harvested using standard phage preparatory methods, e.g., PEG precipitation from growth media. After selection of individual display phages, the nucleic acid encoding the selected protein components, by infecting cells using the selected phages. Individual colonies or plaques can be picked, the nucleic acid isolated and sequenced.

Cell-based Display. In still another format the library is a cell-display library. Proteins are displayed on the surface of a cell, e.g., a eukaryotic or prokaryotic cell. Exemplary prokaryotic cells include *E. coli* cells, *B. subtilis* cells, and spores (see, e.g., Lu et al. (1995) *Biotechnology* 13:366). Exemplary eukaryotic cells include yeast (e.g., *Saccharomyces cerevisiae, Schizosaccharomyces pombe, Hanseula,* or *Pichia pastoris*). Yeast surface display is described, e.g., in Boder and Wittrup (1997) *Nat. Biotechnol.* 15:553-557 and WO 03/029456, which describes a yeast display system that can be used to display immunoglobulin proteins such as Fab fragments and the use of mating to generate combinations of heavy and light chains.

Ribosome Display. RNA and the polypeptide encoded by the RNA can be physically associated by stabilizing ribosomes that are translating the RNA and have the nascent polypeptide still attached. Typically, high divalent $Mg^{2+}$ concentrations and low temperature are used. See, e.g., Mattheakis et al. (1994) *Proc. Natl. Acad. Sci. USA* 91:9022 and Hanes et al. (2000) *Nat Biotechnol.* 18:1287-92; Hanes et al. (2000) *Methods Enzymol.* 328:404-30; and Schaffitzel et al. (1999) *J Immunol Methods.* 231(1-2):119-35.

Polypeptide-Nucleic Acid Fusions. Another format utilizes polypeptide-nucleic acid fusions. Polypeptide-nucleic acid fusions can be generated by the in vitro translation of mRNA that include a covalently attached puromycin group, e.g., as described in Roberts and Szostak (1997) *Proc. Natl. Acad. Sci. USA* 94:12297-12302, and U.S. Pat. No. 6,207,446. The mRNA can then be reverse transcribed into DNA and crosslinked to the polypeptide.

Other Display Formats. Yet another display format is a non-biological display in which the protein component is attached to a non-nucleic acid tag that identifies the polypeptide. For example, the tag can be a chemical tag attached to a bead that displays the polypeptide or a radiofrequency tag (see, e.g., U.S. Pat. No. 5,874,214).

Display technology can also be used to obtain binding proteins, e.g., antibodies that interact with particular epitopes of a target. This can be done, for example, by using competing non-target molecules that lack the particular epitope or are mutated within the epitope, e.g., with alanine. Such non-target molecules can be used in a negative selection procedure as described below, as competing molecules when binding a display library to the target, or as a pre-elution agent, e.g., to capture in a wash solution dissociating display library members that are not specific to the target.

Iterative Selection. In one preferred embodiment, display library technology is used in an iterative mode. A first display library is used to identify one or more binding proteins for a target. These proteins are then varied, e.g., using a mutagenesis method, to form a second display library. Higher affinity binding proteins are then selected from the second library, e.g., by using higher stringency or more competitive binding and washing conditions.

In some implementations, the mutagenesis is targeted to regions known or likely to be at the binding interface. If, for example, the identified binding proteins are antibodies, then mutagenesis can be directed to the CDR regions of the heavy or light chains as described herein. Further, mutagenesis can be directed to framework regions near or adjacent to the CDRs, e.g., framework regions, particular within ten, five, or three amino acids of a CDR junction. In the case of antibodies, mutagenesis can also be limited to one or a few of the CDRs, e.g., to make precise step-wise improvements.

Some exemplary mutagenesis techniques include: error-prone PCR (Leung et al. (1989) *Technique* 1:11-15), recombination (see, e.g., U.S. Ser. No. 10/279,633), DNA shuffling using random cleavage (Stemmer (1994) *Nature* 389-391; termed "nucleic acid shuffling"), RACHITT™ (Coco et al. (2001) *Nature Biotech.* 19:354), site-directed mutagenesis (Zoller et al. (1987) *Nucl Acids Res* 10:6487-6504), cassette mutagenesis (Reidhaar-Olson (1991) *Methods Enzymol.* 208: 564-586) and incorporation of degenerate oligonucleotides (Griffiths et al. (1994) *EMBO J.* 13:3245).

In one example of iterative selection, the methods described herein are used to first identify a binding protein from a display library that binds a Tie1 with at least a minimal binding specificity for a target or a minimal activity, e.g., an equilibrium dissociation constant for binding of greater than 1 nM, 10 nM, or 100 nM. The nucleic acid sequence encoding the initial identified binding protein is used as a template nucleic acid for the introduction of variations, e.g., to identify a second binding protein that has enhanced properties (e.g., binding affinity, kinetics, or stability) relative to the initial binding protein.

Off-Rate Selection. Since a slow dissociation rate can be predictive of high affinity, particularly with respect to interactions between polypeptides and their targets, the methods described herein can be used to isolate binding proteins with a desired kinetic dissociation rate (i.e. reduced) for a binding interaction to a target.

To select for slow dissociating binding proteins from a display library, the library is contacted to an immobilized target. The immobilized target is then washed with a first solution that removes non-specifically or weakly bound biomolecules. Then the immobilized target is eluted with a second solution that includes a saturation amount of free target, i.e., replicates of the target that are not attached to the particle. The free target binds to biomolecules that dissociate from the target. Rebinding is effectively prevented by the saturating amount of free target relative to the much lower concentration of immobilized target.

The second solution can have solution conditions that are substantially physiological or that are stringent. Typically, the solution conditions of the second solution are identical to the solution conditions of the first solution. Fractions of the second solution are collected in temporal order to distinguish early from late fractions. Later fractions include biomolecules that dissociate at a slower rate from the target than biomolecules in the early fractions. It is also possible to recover display library members that remain bound to the target even after extended incubation. These can either be dissociated using chaotropic conditions or can be amplified while attached to the target. For example, phage bound to the target can be contacted to bacterial cells.

Selecting and Screening for Specificity. "Selection" refers to a process in which many members of a display library are allowed to contact the target and those that bind are recovered and propagated. The selection can be from a library having numerous members, e.g., more than $10^{10}$ members. "Screening" refers to a process in which isolated members of the library are tested singly for binding to the target. Through automation, thousands of candidates may be screened in a highly parallel process. The display library selection methods described herein can include a selection process that discards display library members that bind to a non-target molecule. Examples of non-target molecules include, e.g., extracellular domains of molecules that include an immunoglobulin superfamily domain or an EGF domain and receptor tyrosine kinases other than Tie1, e.g., Tie2, or other than Tie2, e.g., Tie1, or other than Tie1 and Tie2. In one implementation, a so-called "negative selection" step is used to discriminate between the target and related non-target molecule and a related, but distinct non-target molecules. The display library or a pool thereof is contacted to the non-target molecule. Members of the sample that do not bind the non-target are collected and used in subsequent selections for binding to the target molecule or even for subsequent negative selections. The negative selection step can be prior to or after selecting library members that bind to the target molecule.

In another implementation, a screening step is used. After display library members are isolated for binding to the target molecule, each isolated library member is tested for its ability to bind to a non-target molecule (e.g., a non-target listed above). For example, a high-throughput ELISA screen can be used to obtain this data. The ELISA screen can also be used to obtain quantitative data for binding of each library member to the target. The non-target and target binding data are compared (e.g., using a computer and software) to identify library members that specifically bind to Tie1, Tie2, Ang, fragments thereof, or a complex comprising one or more such components.

The display library selection and screening methods described herein can include a selection or screening process that selects for display library members that bind to specific sites on the target molecule. For example, elution with high concentration of an antibody described herein can be used to select for phage that bind to an epitope that is near or overlaps with the epitope bound by the antibody used for elution. Accordingly, one can screen for a phage that binds to the E3-binding site of Tie1 by performing ELISAs with and without E3 antibody in the buffer.

The following description provides one exemplary method for identifying antibodies that bind to Tie1 using a phagemid Fab library. For example, three rounds of selection can be performed with decreasing amounts of target protein (e.g., 100, 50 and 50 μg for first, second, and third rounds, respectively). The target is immobilized on streptavidin coated magnetic beads (Dynal). The library is depleted against streptavidin coated magnetic beads prior to each round of selection and optionally against an unrelated protein which may include a common purification handle. For example, if the target is produced as a fusion to a Fc domain, the library can be depleted against soluble Trail-Fc (a commercially available Fc fusion protein). The depletion process removes Fc binders.

Each round of selection can include, e.g., two cycles of streptavidin magnetic bead depletion, a cycle of binding of phage to Tie1-coated beads, ten cycles of washes, elution of bound phage, and propagation of enriched phage for the next round. Phage bound to Tie1-coated beads after ten washes can be directly amplified or eluted before amplification. After three rounds of selection, individual clones may be grown in 96-well microtiter plates and individually screened for Tie1 binding activity by phage ELISA. ELISAs can include evaluations of binding to Tie1, specificity controls, and unrelated controls. Isolates can be DNA fingerprinted to determine the diversity emerging from the selection process. For example, positive isolates can be PCR amplified with the oligonucleotide primers M13-reverse and geneIII-forward (see, e.g., Marks et al. (1991), *J. Mol. Biol.* 222:581). The products can be analyzed by BstNI fingerprinting.

An exemplary method for performing ELISA's with phage that display a binding protein is as follows. Individual clones can be grown and rescued as described previously (Marks et al. (1991), *J. Mol. Biol.* 222:581). For ELISAs, 96-well Immulon 2 HB plates (Thermo Labsystems) are coated with 1 μg/well ImmunoPure™ streptavidin (Pierce) in PBS and incubated overnight at 4° C. After three washes with PBS, 100 μL of biotinylated Tie1 protein is allowed to bind to the immobilized streptavidin for 30-60 minutes at room temperature. Then, Tie1-coated wells are blocked with 300 μL of 2% milk/1×PBS/0.05% Tween (2% MPBST) for two hours at 37° C. The wells are incubated with 100 μL of phage culture supernatant that had been blocked with 2% MPBST for one hour at room temperature. The wells are washed five times with 1×PBS/Tween 0.1% (PBST), and incubated with 100 μL of anti-M13-HRP secondary antibody at a 1:5,000 dilution for one hour at room temperature. The wells are washed five times with PBST before developing with TMB-solution and read at 630 nm.

For the cell ELISAs, cells are washed once in PBS and resuspended at a concentration of $1\times10^6$ to $2\times10^6$ cells/mL of PBS. A final concentration of $1\text{-}2\times10^5$ cells per well of a 96-well tissue culture plate (Falcon, VWR) can be used. The cells are fixed by adding an equal volume of 0.2% glutaraldehyde (Sigma-Aldrich) and incubating at 37° C. for 12 minutes. They are then washed three times with PBS using an automated plate washer (Bio-Tek Instruments, Inc.) and blocked with 200 μL of 2% MPBST for one hour at room temperature. The rest of the ELISA procedure can be performed as described above except that 1×PBS/Tween 0.05% is used for the washes and incubations.

Germlining Antibodies

It is possible to modify an antibody that binds Tie1, Tie2, or Ang, e.g., an antibody described herein, in order to make the variable regions of the antibody more similar to one or more germline sequences. For example, an antibody can include one, two, three or more amino acid substitutions, e.g., in a framework or CDR region, to make it more similar to a reference germline sequence. One exemplary germlining method can include: identifying one or more germline sequences that are similar (e.g., most similar in a particular database) to the sequence of the isolated antibody. Then mutations (at the amino acid level) can be made in the isolated antibody, either incrementally, in combination, or both. For example, a nucleic acid library that includes sequences encoding some or all possible germline mutations is made. The mutated antibodies are then evaluated, e.g., to identify an antibody that has one or more additional germline residues relative to the isolated antibody and that is still useful (e.g., has a functional activity). In one embodiment, as many germline residues are introduced into an isolated antibody as possible.

In one embodiment, mutagenesis is used to substitute or insert one or more germline residues into a CDR region. For example, the germline CDR residue can be from a germline sequence that is similar (e.g., most similar) to the variable region being modified. After mutagenesis, activity (e.g., binding or other functional activity) of the antibody can be evaluated to determine if the germline residue or residues are tolerated. Similar mutagenesis can be performed in the framework regions.

Selecting a germline sequence can be performed in different ways. For example, a germline sequence can be selected if it meets a predetermined criteria for selectivity or similarity, e.g., at least a certain percentage identity, e.g., at least 75, 80, 85, 90, 91, 92, 93, 94, 95, 96, 97, 98, 99, or 99.5% identity. The selection can be performed using at least 2, 3, 5, or 10 germline sequences. In the case of CDR1 and CDR2, identifying a similar germline sequence can include selecting one such sequence. In the case of CDR3, identifying a similar germline sequence can include selecting one such sequence, but may including using two germline sequences that separately contribute to the amino-terminal portion and the carboxy-terminal portion. In other implementations more than one or two germline sequences are used, e.g., to form a consensus sequence.

In one embodiment, with respect to a particular reference variable domain sequence, e.g., a sequence described herein, a related variable domain sequence has at at least 30, 40, 50, 60, 70, 80, 90, 95 or 100% of the CDR amino acid positions that are not identical to residues in the reference CDR sequences, residues that are identical to residues at corresponding positions in a human germline sequence (i.e., an amino acid sequence encoded by a human germline nucleic acid).

In one embodiment, with respect to a particular reference variable domain sequence, e.g., a sequence described herein, a related variable domain sequence has at at least 30, 50, 60, 70, 80, 90 or 100% of the FR regions are identical to FR sequence from a human germline sequence, e.g., a germline sequence related to the reference variable domain sequence.

Accordingly, it is possible to isolate an antibody which has similar activity to a given antibody of interest, but is more similar to one or more germline sequences, particularly one or more human germline sequences. For example, an antibody can be at least 90, 91, 92, 93, 94, 95, 96, 97, 98, 99, 99.5% identical to a germline sequence in a region outside the CDRs (e.g., framework regions). Further an antibody can include at least 1, 2, 3, 4, or 5 germline residues in a CDR region, the germline residue being from a germline sequence of similar (e.g., most similar) to the variable region being modified. Germline sequences of primary interest are human germline sequences. The activity of the antibody (e.g., the binding activity) can be within a factor or 100, 10, 5, 2, 0.5, 0.1, and 0.001 of the original antibody.

Exemplary germline reference sequences for Vkappa include: O12/O2, O18/O8, A20, A30, L14, L1, L15, L4/18a, L5/L19, L8, L23, L9, L24, L11, L12, O11/O1, A17, A1, A18, A2, A19/A3, A23, A27, A11, L2/L16, L6, L20, L25, B3, B2, A26/A10, and A14. See, e.g., Tomlinson et al. (1995) EMBO J. 14(18):4628-3.

A germline reference sequence for the HC variable domain can be based on a sequence that has particular canonical structures, e.g., 1-3 structures in the H1 and H2 hypervariable loops. The canonical structures of hypervariable loops of an immunoglobulin variable domain can be inferred from its sequence, as described in Chothia et al. (1992) *J. Mol. Biol.* 227:799-817; Tomlinson et al. (1992) *J. Mol. Biol.* 227:776-798); and Tomlinson et al. (1995) EMBO J. 14(18):4628-38. Exemplary sequences with a 1-3 structure include: DP-1, DP-8, DP-12, DP-2, DP-25, DP-15, DP-7, DP-4, DP-31, DP-32, DP-33, DP-35, DP-40, 7-2, hv3005, hv3005f3, DP-46, DP-47, DP-58, DP-49, DP-50, DP-51, DP-53, and DP-54.

Diversity

Display libraries and other libraries include variation at one or more positions in the displayed polypeptide. The variation at a given position can be synthetic or natural. For some libraries, both synthetic and natural diversity are included.

Synthetic Diversity. Libraries can include regions of diverse nucleic acid sequence that originate from artificially synthesized sequences. Typically, these are formed from degenerate oligonucleotide populations that include a distribution of nucleotides at each given position. The inclusion of a given sequence is random with respect to the distribution. One example of a degenerate source of synthetic diversity is an oligonucleotide that includes NNN wherein N is any of the four nucleotides in equal proportion.

Synthetic diversity can also be more constrained, e.g., to limit the number of codons in a nucleic acid sequence at a given trinucleotide to a distribution that is smaller than NNN. For example, such a distribution can be constructed using less than four nucleotides at some positions of the codon. In addition, trinucleotide addition technology can be used to further constrain the distribution. So-called "trinucleotide addition technology" is described, e.g., in Wells et al. (1985) *Gene* 34:315-323, U.S. Pat. No. 4,760,025 and U.S. Pat. No. 5,869,644.

Natural Diversity. Libraries can include regions of diverse nucleic acid sequence that originate (or are synthesized based on) from different naturally-occurring sequences. An example of natural diversity that can be included in a display library is the sequence diversity present in immune cells (see also below). Nucleic acids are prepared from these immune cells and are manipulated into a format for polypeptide display.

Antibody Display Libraries

In one embodiment, the display library presents a diverse pool of proteins, each of which includes an immunoglobulin domain, e.g., an immunoglobulin variable domain. Display libraries are particular useful, for example for identifying human or "humanized" antibodies that recognize human antigens. Such antibodies can be used as therapeutics to treat human disorders such as endothelial-related disorders, e.g., metastatic cancer. Since the constant and framework regions of the antibody are human, these therapeutic antibodies may avoid themselves being recognized and targeted as antigens. The constant regions are also optimized to recruit effector functions of the human immune system. The in vitro display selection process surmounts the inability of a normal human immune system to generate antibodies against self-antigens.

A typical antibody display library displays a polypeptide that includes a VH domain and a VL domain. An "immunoglobulin domain" refers to a domain from the variable or constant domain of immunoglobulin molecules. Immunoglobulin domains typically contain two β-sheets formed of about seven β-strands, and a conserved disulphide bond (see, e.g., A. F. Williams and A. N. Barclay 1988 *Ann. Rev Immunol.* 6:381-405). The canonical structures of hypervariable loops of an immunoglobulin variable can be inferred from its sequence, as described in Chothia et al. (1992) *J. Mol. Biol.* 227:799-817; Tomlinson et al. (1992) *J. Mol. Biol.* 227:776-798); and Tomlinson et al. (1995) EMBO J. 14(18):4628-38. The display library can display the antibody as a Fab fragment (e.g., using two polypeptide chains) or a single chain Fv (e.g., using a single polypeptide chain). Other formats can also be used.

As in the case of the Fab and other formats, the displayed antibody can include a constant region as part of a light or heavy chain. In one embodiment, each chain includes one constant region, e.g., as in the case of a Fab. In other embodiments, additional constant regions are displayed.

Antibody libraries can be constructed by a number of processes (see, e.g., de Haard et al. (1999) *J. Biol. Chem* 274: 18218-30; Hoogenboom et al. (1998) *Immunotechnology* 4:1-20. and Hoogenboom et al. (2000) *Immunol Today* 21:371-8). Further, elements of each process can be combined with those of other processes. The processes can be used such that variation is introduced into a single immunoglobulin domain (e.g., VH or VL) or into multiple immunoglobulin domains (e.g., VH and VL). The variation can be introduced into an immunoglobulin variable domain, e.g., in the region of one or more of CDR1, CDR2, CDR3, FR1, FR2, FR3, and FR4, referring to such regions of either and both of heavy and light chain variable domains. In one embodiment, variation is introduced into all three CDRs of a given variable domain. In another preferred embodiment, the variation is introduced into CDR1 and CDR2, e.g., of a heavy chain variable domain. Any combination is feasible.

In one process, antibody libraries are constructed by inserting diverse oligonucleotides that encode CDRs into the corresponding regions of the nucleic acid. The oligonucleotides can be synthesized using monomeric nucleotides or trinucleotides. For example, Knappik et al. (2000) *J. Mol. Biol.* 296: 57-86 describe a method for constructing CDR encoding oligonucleotides using trinucleotide synthesis and a template with engineered restriction sites for accepting the oligonucleotides.

In another process, an animal, e.g., a non-human animal, e.g., a rodent, is immunized with the Tie1. The animal is optionally boosted with the antigen to further stimulate the response. Then spleen cells are isolated from the animal, and nucleic acid encoding VH and/or VL domains is amplified and cloned for expression in the display library. The non-human animal can include one or more human immunoglobulin gene sequences. For example, the animal can include a complete human immunoglobulin locus. The animal may also have an inactivated endogenous immunoglobulin locus.

In yet another process, antibody libraries are constructed from nucleic acid amplified from naïve germline immunoglobulin genes (e.g., human genes). The amplified nucleic acid includes nucleic acid encoding the VH and/or VL domain. Sources of immunoglobulin-encoding nucleic acids are described below. Amplification can include PCR, e.g., with primers that anneal to the conserved constant region, or another amplification method.

Nucleic acid encoding immunoglobulin domains or fragments thereof can be obtained from the immune cells of, e.g., a human, a primate, mouse, rabbit, camel, or rodent. In one example, the cells are selected for a particular property. B cells at various stages of maturity can be selected. In another example, the B cells are naïve.

In one embodiment, fluorescent-activated cell sorting (FACS) is used to sort B cells that express surface-bound IgM, IgD, or IgG molecules. Further, B cells expressing different isotypes of IgG can be isolated. In another preferred embodiment, the B or T cell is cultured in vitro. The cells can be stimulated in vitro, e.g., by culturing with feeder cells or by adding mitogens or other modulatory reagents, such as antibodies to CD40, CD40 ligand or CD20, phorbol myristate acetate, bacterial lipopolysaccharide, concanavalin A, phytohemagglutinin or pokeweed mitogen.

In still another embodiment, the cells are isolated from a subject that has an immunological disorder, e.g., systemic lupus erythematosus (SLE), rheumatoid arthritis, vasculitis, Sjogren syndrome, systemic sclerosis, or anti-phospholipid syndrome. The subject can be a human, or an animal, e.g., an animal model for the human disease, or an animal having an analogous disorder. In yet another embodiment, the cells are isolated from a transgenic non-human animal that includes a human immunoglobulin locus.

In one preferred embodiment, the cells have activated a program of somatic hypermutation. Cells can be stimulated to undergo somatic mutagenesis of immunoglobulin genes, for example, by treatment with anti-immunoglobulin, anti-CD40, and anti-CD38 antibodies (see, e.g., Bergthorsdottir et al. (2001) *J Immunol.* 166:2228). In another embodiment, the cells are naïve.

The nucleic acid encoding an immunoglobulin variable domain can be isolated from a natural repertoire by the following exemplary method. First, RNA is isolated from the immune cell. Full length (i.e., capped) mRNAs are separated (e.g. by dephosphorylating uncapped RNAs with calf intestinal phosphatase). The cap is then removed with tobacco acid pyrophosphatase and reverse transcription is used to produce the cDNAs.

The reverse transcription of the first (antisense) strand can be done in any manner with any suitable primer. See, e.g., de Haard et al. (1999) *J. Biol. Chem* 274:18218-30. The primer binding region can be constant among different immunoglobulins, e.g., in order to reverse transcribe different isotypes of immunoglobulin. The primer binding region can also be specific to a particular isotype of immunoglobulin. Typically, the primer is specific for a region that is 3' to a sequence encoding at least one CDR. In another embodiment, poly-dT primers may be used (and may be preferred for the heavy-chain genes).

A synthetic sequence can be ligated to the 3' end of the reverse transcribed strand. The synthetic sequence can be used as a primer binding site for binding of the forward primer during PCR amplification after reverse transcription. The use of the synthetic sequence can obviate the need to use a pool of different forward primers to fully capture the available diversity.

The variable domain-encoding gene is then amplified, e.g., using one or more rounds. If multiple rounds are used, nested primers can be used for increased fidelity. The amplified nucleic acid is then cloned into a display library vector.

Any method for amplifying nucleic acid sequences may be used for amplification. Methods that maximize and do not bias diversity are preferred. A variety of techniques can be used for nucleic acid amplification. The polymerase chain reaction (PCR; U.S. Pat. Nos. 4,683,195 and 4,683,202, Saiki, et al. (1985) *Science* 230, 1350-1354) utilizes cycles of varying temperature to drive rounds of nucleic acid synthesis. Transcription-based methods utilize RNA synthesis by RNA polymerases to amplify nucleic acid (U.S. Pat. No. 6,066,457; U.S. Pat. No. 6,132,997; U.S. Pat. No. 5,716,785; Sarkar et. al., *Science* (1989) 244: 331-34; Stofler et al., *Science* (1988) 239: 491). NASBA (U.S. Pat. Nos. 5,130,238; 5,409,818; and 5,554,517) utilizes cycles of transcription, reverse-transcription, and RNaseH-based degradation to amplify a DNA sample. Still other amplification methods include rolling circle amplification (RCA; U.S. Pat. Nos. 5,854,033 and 6,143,495) and strand displacement amplification (SDA; U.S. Pat. Nos. 5,455,166 and 5,624,825).

Secondary Screening Methods

After selecting candidate display library members that bind to a target, each candidate display library member can be further analyzed, e.g., to further characterize its binding properties for the target. Similarly candidate binding proteins (e.g., by immunization, etc.) obtained by other methods can also be analyzed. Each candidate binding protein can be subjected to one or more secondary screening assays. The assay can be for a binding property, a catalytic property, a physiological property (e.g., cytotoxicity, renal clearance, immunogenicity), a structural property (e.g., stability, conformation, oligomerization state) or another functional property. The same assay can be used repeatedly, but with varying conditions, e.g., to determine pH, ionic, or thermal sensitivities.

As appropriate, the assays can use the display library member directly, a recombinant polypeptide produced from the nucleic acid encoding a displayed polypeptide, or a synthetic peptide synthesized based on the sequence of a displayed polypeptide. Exemplary assays for binding properties include the following.

ELISA. Proteins encoded by a display library can also be screened for a binding property using an ELISA assay. For example, each protein is contacted to a microtitre plate whose bottom surface has been coated with the target, e.g., a limiting amount of the target. The plate is washed with buffer to remove non-specifically bound polypeptides. Then the amount of the protein bound to the plate is determined by probing the plate with an antibody that can recognize the polypeptide, e.g., a tag or constant portion of the polypeptide. The antibody is linked to an enzyme such as alkaline phosphatase, which produces a colorimetric product when appropriate substrates are provided. The protein can be purified from cells or assayed in a display library format, e.g., as a fusion to a filamentous bacteriophage coat. Alternatively, cells (e.g., live or fixed) that express the target molecule, e.g., Tie1, Tie2, or Ang, can be plated in a microtitre plate and used to test the affinity of the peptides/antibodies present in the display library or obtained by selection from the display library.

Cell Binding Assays. Binding proteins (e.g., Tie1, Tie2, or Ang binding proteins) can be evaluated for their ability to interact with one or more cell types, e.g., endothelial cells or platelets. Fluorescent activated cell sorting (FACS) is one exemplary method for testing an interaction between a protein and a cell. The binding protein is labeled directly or indirectly with a fluorophore, before or after, binding to the cells, and then cells are counted in a FACS sorter.

For example, the following method can be used to evaluate whether a Tie1 binding protein interacts with platelets or other cell types.

Isolation of Platelets. Human blood can be obtained from informed healthy volunteers. For example, venous blood is collected into one-sixth volume of ACD (2.5 g of sodium citrate, 1.5 g citric acid, and 2.5 g glucose in 100 ml $dH_2O$). The blood is centrifuged at 800×g for 15 min at room temperature and the platelet-rich plasma is removed and incubated for 60 min at 37° C. in the presence of 1 mM acetylsalicylic acid followed by centrifugation at 1000×g for 10 min at room temperature. The platelet pellet can be resuspended at a density of $2\times10^8$ cells/ml with HEPES-buffered Tyrode's solution (137 mM NaCl, 2.7 mM KCl, 1 mM $MgCl_2$, 3 mM $NaH_2PO_4$, 5 mM glucose, 10 mM HEPES pH 7.4, 0.2% bovine serum albumin, and 0.05 U/mL apyrase). See also, e.g., Komecki et al. (1990) J Biol. Chem. 265:10,042-10,048 and Naik et al. (1995) Biochem J. 310:155-162).

FACS. For example, for FACS analysis of platelets, cells can be resuspended in 0.1% BSA/PBS ($4\times10^5$ cells/sample) in the presence of PGE1 (1 mg/mL) and incubated with a candidate Tie1 binding protein (e.g., at about 5 µg/mL) or with a control. After a 1-hour incubation at 22° C., the cells are washed with 0.1% BSA/PBS, treated with 50 µL 1/100 diluted FITC-labeled secondary antibody, incubated for 30 minutes on ice, washed, and resuspended in 0.1% BSA/PBS. The samples are analyzed using an Immunocytometry Systems flow cytometer (FACSORT™, Becton Dickinson, San Jose, Calif.). See also, e.g., Malgorzata et al. (2000) Blood, Vol. 95 No. 8 (April 15 pp. 2600-2609.

In addition, it is possible to evaluate platelets by Westerns analysis of SDS-page separated proteins from isolated platelets and by immunoprecipitation. Still other methods involve binding cells to surfaces to which the Tie1-binding protein is attached (e.g., coated to).

Other cell types can be prepared for FACS by methods known in the art.

Homogeneous Binding Assays. The binding interaction of candidate polypeptide with a target can be analyzed using a homogenous assay, i.e., after all components of the assay are added, additional fluid manipulations are not required. For example, fluorescence resonance energy transfer (FRET) can be used as a homogenous assay (see, for example, Lakowicz et al., U.S. Pat. No. 5,631,169; Stavrianopoulos, et al., U.S. Pat. No. 4,868,103). A fluorophore label on the first molecule (e.g., the molecule identified in the fraction) is selected such that its emitted fluorescent energy can be absorbed by a fluorescent label on a second molecule (e.g., the target) if the second molecule is in proximity to the first molecule. The fluorescent label on the second molecule fluoresces when it absorbs to the transferred energy. Since the efficiency of energy transfer between the labels is related to the distance separating the molecules, the spatial relationship between the molecules can be assessed. In a situation in which binding occurs between the molecules, the fluorescent emission of the 'acceptor' molecule label in the assay should be maximal. A binding event that is configured for monitoring by FRET can be conveniently measured through standard fluorometric detection means well known in the art (e.g., using a fluorimeter). By titrating the amount of the first or second binding molecule, a binding curve can be generated to estimate the equilibrium binding constant.

Surface Plasmon Resonance (SPR). The binding interaction of a molecule isolated from a display library and a target can be analyzed using SPR. SPR or Biomolecular Interaction Analysis (BIA) detects biospecific interactions in real time, without labeling any of the interactants. Changes in the mass at the binding surface (indicative of a binding event) of the BIA chip result in alterations of the refractive index of light near the surface (the optical phenomenon of surface plasmon resonance (SPR)). The changes in the refractivity generate a detectable signal, which are measured as an indication of real-time reactions between biological molecules. Methods for using SPR are described, for example, in U.S. Pat. No. 5,641,640; Raether (1988) *Surface Plasmons* Springer Verlag; Sjolander and Urbaniczky (1991) *Anal. Chem.* 63:2338-2345; Szabo et al. (1995) *Curr. Opin. Struct. Biol.* 5:699-705 and on-line resources provide by BIAcore International AB (Uppsala, Sweden).

Information from SPR can be used to provide an accurate and quantitative measure of the equilibrium dissociation constant ($K_d$), and kinetic parameters, including $K_{on}$ and $K_{off}$ for the binding of a biomolecule to a target. Such data can be used to compare different biomolecules. For example, different proteins can be compared to identify individuals that have high affinity for the target or that have a slow $K_{off}$. This information can also be used to develop structure-activity relationships (SAR). For example, the kinetic and equilibrium binding parameters of matured versions of a parent protein can be compared to the parameters of the parent protein. Variant amino acids at given positions can be identified that correlate with particular binding parameters, e.g., high affinity and slow $K_{off}$. This information can be combined with structural modeling (e.g., using homology modeling, energy minimization, or structure determination by crystallography or NMR). As a result, an understanding of the physical interaction between the protein and its target can be formulated and used to guide other design processes.

Protein Arrays. Proteins identified from the display library can be immobilized on a solid support, for example, on a bead or an array. For a protein array, each of the polypeptides is immobilized at a unique address on a support. Typically, the address is a two-dimensional address. Protein arrays are described below (see, e.g., Diagnostics). It is also possible to use a protein array to evaluate any plurality of proteins, e.g., for interaction with Tie1, Tie2, or Ang.

Cellular Assays. Candidate proteins can be selected from a library by transforming the library into a host cell; the library could have been previously identified from a display library. For example, the library can include vector nucleic acid sequences that include segments that encode the polypeptides and that direct expression, e.g., such that the proteins are produced within the cell, secreted from the cell, or attached to the cell surface. The cells can be screened or selected for proteins that bind to the Tie1, Tie2, or Ang, e.g., as detected by a change in a cellular phenotype or a cell-mediated activity. For example, in the case of an antibody that binds to Tie1, the activity may be autophosphorylation, activation of PI3 Kinase, activation of AKT, or a change in endothelial cell activity (e.g., proliferation).

In another embodiment, the library of cells is in the form of a cellular array. The cellular array can likewise be screened for any appropriate detectable activity. In other embodiments, competition binding assays are used to identify proteins that are compete with a reference protein for binding to Tie1. Similarly, epitope mapping can be used to identify proteins that bind to a particular epitope of Tie. Fragments and mutants of Tie1 can be also be used in the binding protein-identification process, e.g., in one or more of characterization, screening, or immunization.

Methods for Obtaining Target-Binding Antibodies

In addition to the use of display libraries, other methods can be used to obtain a target-binding antibody or in combination with the use of display libraries. For example, the Tie1 ectodomain or a region thereof can be used as an antigen in a non-human animal, e.g., a rodent. Similarly, Tie2 or Ang, or a region thereof can be used as an antigen in a non-human animal, e.g., a rodent.

In one embodiment, the non-human animal includes at least a part of a human immunoglobulin gene. For example, it is possible to engineer mouse strains deficient in mouse antibody production with large fragments of the human Ig loci. Using the hybridoma technology, antigen-specific Mabs derived from the genes with the desired specificity may be produced and selected. See, e.g., XenoMouse™, Green et al. Nature Genetics 7:13-21 (1994), U.S. Pat. No. 2,003,0070185, WO 96/34096, published Oct. 31, 1996, and PCT Application No. PCT/US96/05928, filed Apr. 29, 1996.

In another embodiment, a monoclonal antibody is obtained from the non-human animal, and then modified, e.g., humanized or deimmunized. Winter describes a CDR-grafting method that may be used to prepare the humanized antibodies (UK Patent Application GB 2188638A, filed on Mar. 26, 1987; Winter U.S. Pat. No. 5,225,539. All of the CDRs of a particular human antibody may be replaced with at least a portion of a non-human CDR or only some of the CDRs may be replaced with non-human CDRs. It is only necessary to replace the number of CDRs required for binding of the humanized antibody to a predetermined antigen.

Humanized antibodies can be generated by replacing sequences of the Fv variable region that are not directly involved in antigen binding with equivalent sequences from human Fv variable regions. General methods for generating humanized antibodies are provided by Morrison, S. L., 1985, *Science* 229:1202-1207, by Oi et al., 1986, *BioTechniques* 4:214, and by Queen et al. U.S. Pat. No. 5,585,089, U.S. Pat. No. 5,693,761 and U.S. Pat. No. 5,693,762. Those methods include isolating, manipulating, and expressing the nucleic acid sequences that encode all or part of immunoglobulin Fv variable regions from at least one of a heavy or light chain. Sources of such nucleic acid are well known to those skilled in the art and, for example, may be obtained from a hybridoma producing an antibody against a predetermined target, as described above. The recombinant DNA encoding the humanized antibody, or fragment thereof, can then be cloned into an appropriate expression vector.

A target-binding antibody may also be modified by specific deletion of human T cell epitopes or "deimmunization" by the methods disclosed in WO 98/52976 and WO 00/34317, the contents of which are specifically incorporated by reference herein. Briefly, the heavy and light chain variable regions of an antibody can be analyzed for peptides that bind to MHC Class II; these peptides represent potential T-cell epitopes (as defined in WO 98/52976 and WO 00/34317). For detection of potential T-cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T-cell epitopes detected can be eliminated by substituting small numbers of amino acid residues in the variable regions, or preferably, by single amino acid substitutions. As far as possible conservative substitutions are made, often but not exclusively, an amino acid common at this position in human germline antibody sequences may be used. Human germline sequences are disclosed in Tomlinson, I. A. et al. (1992) *J. Mol. Biol.* 227:776-798; Cook, G. P. et al. (1995) *Immunol. Today* Vol. 16 (5): 237-242; Chothia, D. et al. (1992) *J. Mol. Bio.* 227:799-817. The V BASE directory provides a comprehensive directory of human immunoglobulin variable region sequences (compiled by Tomlinson, I. A. et al. MRC Centre for Protein Engineering, Cambridge, UK). After the deimmunizing changes are identified, nucleic acids encoding VH and VL can be constructed by mutagenesis or other synthetic methods (e.g., de novo synthesis, cassette replacement, and so forth). Mutagenized variable sequence can, optionally, be fused to a human constant region, e.g., human IgG1 or K constant regions.

In some cases a potential T cell epitope will include residues which are known or predicted to be important for antibody function. For example, potential T cell epitopes are usually biased towards the CDRs. In addition, potential T cell epitopes can occur in framework residues important for antibody structure and binding. Changes to eliminate these potential epitopes will in some cases require more scrutiny, e.g., by making and testing chains with and without the change. Where possible, potential T cell epitopes that overlap the CDRs were eliminated by substitutions outside the CDRs. In some cases, an alteration within a CDR is the only option, and thus variants with and without this substitution should be tested. In other cases, the substitution required to remove a potential T cell epitope is at a residue position within the framework that might be critical for antibody binding. In these cases, variants with and without this substitution should be tested. Thus, in some cases several variant deimmunized heavy and light chain variable regions were designed and various heavy/light chain combinations tested in order to identify the optimal deimmunized antibody. The choice of the final deimmunized antibody can then be made by considering the binding affinity of the different variants in conjunction with the extent of deimmunization, i.e., the number of potential T cell epitopes remaining in the variable region. Deimmunization can be used to modify an antibody that includes a non-human sequence, e.g., a murine antibody or other non-human monoclonal antibody. Deimmunization can be used to modify an antibody isolated from a display library.

Endothelial Cell Assays

A target-binding protein or a candidate binding protein can be characterized using a cellular assay, e.g., to evaluate a change in a cellular phenotype or other activity when the binding protein is contacted to the cell. Typically the cell is expresses a protein that includes at least part of the ectodomain of Tie. In some embodiments, the cell expresses Tie1, e.g., a full-length, mature Tie1 protein, Tie2, and/or is contacted with Ang.

Endothelial cell proliferation. A candidate target-binding protein can be tested for endothelial proliferation inhibiting activity using a biological activity assay such as the bovine capillary endothelial cell proliferation assay, the chick CAM assay, the mouse corneal assay, and evaluating the effect of the binding protein on implanted tumors. The chick CAM assay is described, e.g., by O'Reilly, et al. in "Angiogenic Regulation of Metastatic Growth" Cell, vol. 79 (2), Oct. 21, 1994, pp. 315-328. Briefly, three day old chicken embryos with intact yolks are separated from the egg and placed in a petri dish. After three days of incubation a methylcellulose disc containing the protein to be tested is applied to the CAM of individual embryos. After 48 hours of incubation, the embryos and CAMs are observed to determine whether endothelial growth has been inhibited. The mouse corneal assay involves implanting a growth factor-containing pellet, along with another pellet containing the suspected endothelial growth inhibitor, in the cornea of a mouse and observing the pattern of capillaries that are elaborated in the cornea.

Angiogenesis. Angiogenesis may be assayed, e.g., using various human endothelial cell systems, such as umbilical vein, coronary artery, or dermal cells. Suitable assays include Alamar Blue based assays (available from Biosource International) to measure proliferation; migration assays using fluorescent molecules, such as the use of Becton Dickinson Falcon HTS FLUOROBLOCK™ cell culture inserts to measure migration of cells through membranes in presence or absence of angiogenesis enhancer or suppressors; and tubule formation assays based on the formation of tubular structures by endothelial cells on MATRIGEL™ (Becton Dickinson) or collagen I.

Cell adhesion. Cell adhesion assays measure adhesion of cells to purified adhesion proteins or adhesion of cells to each other, in presence or absence of candidate target-binding proteins. Cell-protein adhesion assays measure the ability of agents to modulate the adhesion of cells to purified proteins. For example, recombinant proteins are produced, diluted to 2.5 g/mL in PBS, and used to coat the wells of a microtiter plate. The wells used for negative control are not coated. Coated wells are then washed, blocked with 1% BSA, and washed again. Compounds are diluted to 2×final test concentration and added to the blocked, coated wells. Cells are then added to the wells, and the unbound cells are washed off. Retained cells are labeled directly on the plate by adding a membrane-permeable fluorescent dye, such as calcein-AM, and the signal is quantified in a fluorescent microplate reader.

Cell-cell adhesion assays can be used to measure the ability of candidate target-binding proteins to modulate binding of cells to each other. These assays can use cells that naturally or recombinantly express an adhesion protein of choice. In an exemplary assay, cells expressing the cell adhesion protein are plated in wells of a multiwell plate together with other cells (either more of the same cell type, or another type of cell to which the cells adhere). The cells that can adhere are labeled with a membrane-permeable fluorescent dye, such as BCECF, and allowed to adhere to the monolayers in the presence of candidate binding proteins. Unbound cells are washed off, and bound cells are detected using a fluorescence plate reader. High-throughput cell adhesion assays have also been described. See, e.g., Falsey J R et al., Bioconjug Chem. May-June 2001; 12(3):346-53.

Tubulogenesis. Tubulogenesis assays can be used to monitor the ability of cultured cells, generally endothelial cells, to form tubular structures on a matrix substrate, which generally simulates the environment of the extracellular matrix. Exemplary substrates include MATRIGEL™ (Becton Dickinson), an extract of basement membrane proteins containing laminin, collagen IV, and heparin sulfate proteoglycan, which is liquid at 4° C. and forms a solid gel at 37° C. Other suitable matrices comprise extracellular components such as collagen, fibronectin, and/or fibrin. Cells are stimulated with a pro-angiogenic stimulant, and their ability to form tubules is detected by imaging. Tubules can generally be detected after an overnight incubation with stimuli, but longer or shorter time frames may also be used. Tube formation assays are well known in the art (e.g., Jones M K et al., 1999, Nature Medicine 5:1418-1423). These assays have traditionally involved stimulation with serum or with the growth factors FGF or VEGF. In one embodiment, the assay is performed with cells cultured in serum free medium. In one embodiment, the assay is performed in the presence of one or more pro-angiogenic agents, e.g., inflammatory angiogenic factors such as TNF-α, or FGF, VEGF, phorbol myristate acetate (PMA), TNF-alpha, ephrin, etc.

Cell Migration. An exemplary assay for endothelial cell migration is the human microvascular endothelial (HMVEC) migration assay. See, e.g., Tolsma et al. (1993) J. Cell Biol 122, 497-511. Migration assays are known in the art (e.g., Paik J H et al., 2001, J Biol Chem 276:11830-11837). In one example, cultured endothelial cells are seeded onto a matrix-coated porous lamina, with pore sizes generally smaller than typical cell size. The lamina is typically a membrane, such as the transwell polycarbonate membrane (Corning Costar Corporation, Cambridge, Mass.), and is generally part of an upper chamber that is in fluid contact with a lower chamber containing pro-angiogenic stimuli. Migration is generally assayed after an overnight incubation with stimuli, but longer or shorter time frames may also be used. Migration is assessed as the number of cells that crossed the lamina, and may be detected by staining cells with hemotoxylin solution (VWR Scientific.), or by any other method for determining cell number. In another exemplary set up, cells are fluorescently labeled and migration is detected using fluorescent readings, for instance using the Falcon HTS FLUOROBLOK™ (Becton Dickinson). While some migration is observed in the absence of stimulus, migration is greatly increased in response to pro-angiogenic factors. The assay can be used to test the effect of a target-binding protein on endothelial cell migration.

Sprouting assay. An exemplary sprouting assay is a three-dimensional in vitro angiogenesis assay that uses a cell-number defined spheroid aggregation of endothelial cells ("spheroid"), embedded in a collagen gel-based matrix. The spheroid can serve as a starting point for the sprouting of capillary-like structures by invasion into the extracellular matrix (termed "cell sprouting") and the subsequent formation of complex anastomosing networks (Korff and Augustin, 1999, J Cell Sci 112:3249-58). In an exemplary experimental set-up, spheroids are prepared by pipetting 400 human umbilical vein endothelial cells into individual wells of a nonadhesive 96-well plates to allow overnight spheroidal aggregation (Korff and Augustin: J Cell Biol 143: 1341-52, 1998). Spheroids are harvested and seeded in 900 μl of methocel-collagen solution and pipetted into individual wells of a 24 well plate to allow collagen gel polymerization. Test agents are added after 30 min by pipetting 100 μl of 10-fold concentrated working dilution of the test substances on top of the gel. Plates are incubated at 37° C. for 24 h. Dishes are fixed at the end of the experimental incubation period by addition of paraformaldehyde. Sprouting intensity of endothelial cells can be quantitated by an automated image analysis system to determine the cumulative sprout length per spheroid.

In some embodiments, a target-binding protein has a statistically significant effect on an assay described herein, e.g., a cellular assay desribed herein.

Protein Production

Standard recombinant nucleic acid methods can be used to express a binding proteinthat binds to Tie1, Tie2, or Ang. See, for example, the techniques described in Sambrook & Russell, *Molecular Cloning: A Laboratory Manual*, 3$^{rd}$ Edition, Cold Spring Harbor Laboratory, N.Y. (2001) and Ausubel et al., Current Protocols in Molecular Biology (Greene Publishing Associates and Wiley Interscience, N.Y. (1989). Generally, a nucleic acid sequence encoding the binding proteinis cloned into a nucleic acid expression vector. If the protein includes multiple polypeptide chains, each chain can be cloned into an expression vector, e.g., the same or different vectors, that are expressed in the same or different cells. Methods for producing antibodies are also provided below.

Antibody Production. Some antibodies, e.g., Fabs, can be produced in bacterial cells, e.g., *E. coli* cells. For example, if the Fab is encoded by sequences in a phage display vector that includes a suppressible stop codon between the display entity and a bacteriophage protein (or fragment thereof), the vector nucleic acid can be shuffled into a bacterial cell that cannot suppress a stop codon. In this case, the Fab is not fused to the gene III protein and is secreted into the media.

Antibodies can also be produced in eukaryotic cells. In one embodiment, the antibodies (e.g., scFv's) are expressed in a yeast cell such as *Pichia* (see, e.g., Powers et al. (2001) *J Immunol Methods.* 251:123-35), Hanseula, or *Saccharomyces*.

In one embodiment, antibodies are produced in mammalian cells. Preferred mammalian host cells for expressing the clone antibodies or antigen-binding fragments thereof include Chinese Hamster Ovary (CHO cells) (including dhfr– CHO cells, described in Urlaub and Chasin (1980) *Proc. Natl. Acad. Sci. USA* 77:4216-4220, used with a DHFR selectable marker, e.g., as described in Kaufman and Sharp (1982) *Mol. Biol.* 159:601-621), lymphocytic cell lines, e.g., NS0 myeloma cells, SP2 cells, COS cells, HEK 293T cells, and a cell from a transgenic animal, e.g., a transgenic mammal. For example, the cell is a mammary epithelial cell.

In addition to the nucleic acid sequence encoding the immunoglobulin domain, the recombinant expression vectors may carry additional sequences, such as sequences that regulate replication of the vector in host cells (e.g., origins of replication) and selectable marker genes. The selectable marker gene facilitates selection of host cells into which the vector has been introduced (see e.g., U.S. Pat. Nos. 4,399, 216, 4,634,665 and 5,179,017). For example, typically the selectable marker gene confers resistance to drugs, such as G418, hygromycin or methotrexate, on a host cell into which the vector has been introduced. Preferred selectable marker genes include the dihydrofolate reductase (DHFR) gene (for use in dhfr⁻ host cells with methotrexate selection/amplification) and the *neo gene (for G*418 selection). Another exemplary expression system is the glutamine synthase (GS) vector system available from Lonza Group Ltd. CH (see, e.g., Clark et al. (2004) BioProcess International 2(4):48-52; Barnes et al. (2002) Biotech Bioeng. 81(6):631-639).

In an exemplary system for recombinant expression of an antibody, or antigen-binding portion thereof, a recombinant expression vector encoding both the antibody heavy chain and the antibody light chain is introduced into dhfr– CHO cells by calcium phosphate-mediated transfection. Within the recombinant expression vector, the antibody heavy and light chain genes are each operatively linked to enhancer/promoter regulatory elements (e.g., derived from SV40, CMV, adenovirus and the like, such as a CMV enhancer/AdMLP promoter regulatory element or an SV40 enhancer/AdMLP promoter regulatory element) to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the antibody heavy and light chains and intact antibody is recovered from the culture medium. Standard molecular biology techniques are used to prepare the recombinant expression vector, transfect the host cells, select for transformants, culture the host cells and recover the antibody from the culture medium. For example, some antibodies can be isolated by affinity chromatography with a Protein A or Protein G.

The codon usage can be adapted to the codon bias of the host cell, e.g., for CHO cells it can be adapted for the codon bias *Cricetulus griseus* genes. In addition, regions of very high (>80%) or very low (<30%) GC content can be avoid avoided where possible. During the optimization process following cis-acting sequence motifs were avoided: internal TATA-boxes; chi-sites and ribosomal entry sites; AT-rich or GC-rich sequence stretches; ARE, INS, CRS sequence elements; repeat sequences and RNA secondary structures; and (cryptic) splice donor and acceptor sites, branch points. Two STOP codons can be used to ensure efficient termination. The codon optimization of the sequence can be evaluated according to Sharp, P. M., Li, W. H., Nucleic Acids Res. 15 (3), 1987). The standard codon adaptation index (CAI) can be used. Rare codons include those with a quality class between 0-40.

The invention features isolated nucleic acid molecules that are altered relative to a sequence described herein, e.g., to include improved codons or sequence features, include an isolated nucleic acid molecule that comprises a heavy or light chain coding sequence. For example, at least 30, 40, 45, 50, 60, 65, 70, 75, or 80% of the codons in the heavy or light chain coding sequence are non-rare or frequent codons in a mammalian cell or the heavy or light chain coding sequence includes fewer than 50, 45, 40, 35, 30, 25, 20, 15, 10% rare codons in a mammalian cell, e.g., a Chinese hamster cell (*Cricetulus griseus*). In one embodiment, the codon adaptation index is greater than 0.6, 0.7, 0.8, 0.85, 0.90, 0.92, 0.94, 0.95, 0.96, 0.97, or 0.98.

In one embodiment, the heavy chain coding sequence encodes (i) a polypeptide comprising an antibody heavy chain described herein (e.g., an E3 heavy chain as set forth in SEQ ID NO:723), (ii) a polypeptide at least 85, 90, 95, 96, 97, 98, or 99% identical to an antibody heavy chain coding sequence described herein (e.g., SEQ ID NO:723), or (iii) a polypeptide that comprises a heavy chain variable domain sequence having the CDRs of an antibody heavy chain variable domain described herein (e.g., an E3 heavy chain variable domain). In one embodiment, the heavy chain coding sequence differs from SEQ ID NO:703 at at least 2, 3, 5, 6, 8, 9, 10, or 15 codons.

In one embodiment, the light chain coding sequence encodes (i) a polypeptide comprising an antibody light chain described herein (e.g., an E3 light chain as set forth in SEQ ID NO:724), (ii) a polypeptide at least 85, 90, 95, 96, 97, 98, or 99% identical to an antibody light chain coding sequence described herein (e.g., SEQ ID NO:724), or (iii) a polypeptide that comprises a light chain variable domain sequence having the CDRs of an antibody light chain variable domain described herein (e.g., an E3 light chain variable domain). In one embodiment, the light chain coding sequence differs from SEQ ID NO:702 at at least 3, 5, 6, 8, 9, 10, or 15 codons.

In one embodiment, for example, one or more of the ala-GCG codons can be changed to GCC; one or more of the arg-CGT codons are changed to CGC; one or more of the pro-CCG codons are changed to CCC, CCT, or CCA; one or more of the ser-TCG codons are changed to TCC; and/or one or more of the thr-ACG codons are changed to ACC.

Codon-altered (e.g., codon-optimized) sequences can be used to produce an antibody. An exemplary method includes providing a mammalian cell that includes an antibody-coding nucleic acid and expressing the nucleic acid in the cell, e.g., maintaining the cell under conditions in which the protein is expressed. The antibody-coding nucleic acid can be providing in a mammalian expression vector, e.g., a vector that is introduced into the cell. The cell can be a non-human mammalian cell, e.g., a CHO cell.

For antibodies that include an Fc domain, the antibody production system preferably synthesizes antibodies in which the Fc region is glycosylated. For example, the Fc domain of IgG molecules is glycosylated at asparagine 297 in the CH2 domain. This asparagine is the site for modification with biantennary-type oligosaccharides. It has been demonstrated that this glycosylation is required for effector functions mediated by Fcγ receptors and complement C1q (Burton and Woof (1992) *Adv. Immunol.* 51:1-84; Jefferis et al. (1998) *Immunol. Rev.* 163:59-76). In a preferred embodiment, the Fc domain is produced in a mammalian expression system that appropriately glycosylates the residue corresponding to asparagine 297. The Fc domain can also include other eukaryotic post-translational modifications.

Antibodies can also be produced by a transgenic animal. For example, U.S. Pat. No. 5,849,992 describes a method of expressing an antibody in the mammary gland of a transgenic mammal. A transgene is constructed that includes a milk-specific promoter and nucleic acids encoding the antibody of interest and a signal sequence for secretion. The milk produced by females of such transgenic mammals includes, secreted-therein, the antibody of interest. The antibody can be purified from the milk, or for some applications, used directly.

It is also possible to produce antibodies that bind to Tie1, Tie2, or Ang by immunization, e.g., using an animal, e.g., with natural, human, or partially human immunoglobulin loci. Such an antibody can be of any allotype, e.g., a,z allotype, f allotype, or non-A allotype. Non-human antibodies can also be modified to include substitutions for human immunoglobulin sequences, e.g., consensus human amino acid residues at particular positions, e.g., at one or more of the following positions (preferably at least five, ten, twelve, or all): (in the FR of the variable domain of the light chain) 4L, 35L, 36L, 38L, 43L, 44L, 58L, 46L, 62L, 63L, 64L, 65L, 66L, 67L, 68L, 69L, 70L, 71L, 73L, 85L, 87L, 98L, and/or (in the FR of the variable domain of the heavy chain) 2H, 4H, 24H, 36H, 37H, 39H, 43H, 45H, 49H, 58H, 60H, 67H, 68H, 69H, 70H, 73H, 74H, 75H, 78H, 91H, 92H, 93H, and/or 103H (according to the Kabat numbering). See, e.g., U.S. Pat. No. 6,407,213.

Tie1 production. Methods for producing Tie1 ectodomain protein, Tie1 protein, or Tie1 liposomes are known in the art. See, e.g., WO 93/14124. Methods for producing Tie2 and Ang are similarly known. See e.g., U.S. Pat. Nos. 6,521,424, 6,376,653; WO 96/11269; WO 96/31598.

Biotinylation Methods. A variety of methods are available to biotinylate proteins, e.g., an immunoglobulin protein or a target protein. For example, the protein can be incubated with a 5-fold molar excess of sulfo-NHS-SS-biotin in 50 mM HEPES, pH 8.0, 100 mM NaCl overnight at 4° C. Free biotin is removed by buffer exchange into PBS, 0.01% Tween 20, e.g., using a BIOMAX® device with a 10 kDa molecular weight cut-off membrane or by dialysis. The number of biotin molecules incorporated per mole of protein can be determined using the HABA assay as described by the manufacturer (Pierce).

Pharmaceutical Compositions

In another aspect, the invention provides compositions, e.g., pharmaceutically acceptable compositions, which include an agent that binds to Tie1, Tie2, or Ang, e.g., an antibody molecule, other polypeptide or peptide identified as binding to Tie1, Tie2, or Ang, or described herein, formulated with a pharmaceutically acceptable carrier. Pharmaceutical compositions encompass labeled binding proteins (e.g., for in vivo imaging) as well as therapeutic compositions.

As used herein, "pharmaceutically acceptable carrier" includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal or epidermal administration (e.g., by injection or infusion). Depending on the route of administration, the binding protein, may be coated in a material to protect the compound from the action of acids and other natural conditions that may inactivate the compound.

A "pharmaceutically acceptable salt" refers to a salt that retains the desired biological activity of the parent compound and does not impart any undesired toxicological effects (see e.g., Berge, S. M., et al. (1977) *J. Pharm. Sci.* 66:1-19). Examples of such salts include acid addition salts and base addition salts. Acid addition salts include those derived from nontoxic inorganic acids, such as hydrochloric, nitric, phosphoric, sulfuric, hydrobromic, hydroiodic, phosphorous and the like, as well as from nontoxic organic acids such as aliphatic mono- and dicarboxylic acids, phenyl-substituted alkanoic acids, hydroxy alkanoic acids, aromatic acids, aliphatic and aromatic sulfonic acids and the like. Base addition salts include those derived from alkaline earth metals, such as sodium, potassium, magnesium, calcium and the like, as well as from nontoxic organic amines, such as N,N'-dibenzylethylenediamine, N-methylglucamine, chloroprocaine, choline, diethanolamine, ethylenediamine, procaine and the like.

Compositions may be in a variety of forms. These include, for example, liquid, semi-solid and solid dosage forms, such as liquid solutions (e.g., injectable and infusible solutions), dispersions or suspensions, tablets, pills, powders, liposomes and suppositories. The preferred form depends on the intended mode of administration and therapeutic application. Typical preferred compositions are in the form of injectable or infusible solutions, such as compositions similar to those used for administration of humans with antibodies. The preferred mode of administration is parenteral (e.g., intravenous, subcutaneous, intraperitoneal, intramuscular). In a preferred embodiment, the target-binding protein is administered by intravenous infusion or injection. In another preferred embodiment, the target-binding protein is administered by intramuscular or subcutaneous injection.

The phrases "parenteral administration" and "administered parenterally" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

The composition can be formulated as a solution, microemulsion, dispersion, liposome, or other ordered structure suitable to high drug concentration. Sterile injectable solutions can be prepared by incorporating the binding protein in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

The binding proteins described herein can be administered by a variety of methods known in the art, although for many applications, the preferred route/mode of administration is intravenous injection or infusion. For example, for therapeutic applications, the target-binding protein can be administered by intravenous infusion, e.g., at a rate of less than 30, 20, 10, 5, or 1 mg/min to reach a dose of about 1 to 100 mg/m$^2$ or 7 to 25 mg/m$^2$. The route and/or mode of administration will vary depending upon the desired results. In certain embodiments, the active compound may be prepared with a carrier that will protect the compound against rapid release, such as a controlled release formulation, including implants, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known. See, e.g., *Sustained and Controlled Release Drug Delivery Systems*, J. R. Robinson, ed., Marcel Dekker, Inc., New York, 1978.

In certain embodiments, the binding protein may be orally administered, for example, with an inert diluent or an assimilable edible carrier. The compound (and other ingredients, if desired) may also be enclosed in a hard or soft shell gelatin capsule, compressed into tablets, or incorporated directly into the subject's diet. For oral therapeutic administration, the compounds may be incorporated with excipients and used in the form of ingestible tablets, buccal tablets, troches, capsules, elixirs, suspensions, syrups, wafers, and the like. To administer a compound described herein by other than parenteral administration, it may be necessary to coat the compound with, or co-administer the compound with, a material to prevent its inactivation.

Pharmaceutical compositions can be administered with medical devices known in the art. For example, in a preferred embodiment, a pharmaceutical can be administered with a needleless hypodermic injection device, such as the devices disclosed in U.S. Pat. Nos. 5,399,163, 5,383,851, 5,312,335, 5,064,413, 4,941,880, 4,790,824, or 4,596,556. Examples of implants and modules include: U.S. Pat. No. 4,487,603, which discloses an implantable micro-infusion pump for dispensing medication at a controlled rate; U.S. Pat. No. 4,486,194, which discloses a therapeutic device for administering medicants through the skin; U.S. Pat. No. 4,447,233, which discloses a medication infusion pump for delivering medication at a precise infusion rate; U.S. Pat. No. 4,447,224, which discloses a variable flow implantable infusion apparatus for continuous drug delivery; U.S. Pat. No. 4,439,196, which discloses an osmotic drug delivery system having multichamber compartments; and U.S. Pat. No. 4,475,196, which discloses an osmotic drug delivery system. Of course, many other such implants, delivery systems, and modules are also known.

In certain embodiments, a binding protein described herein can be formulated to ensure proper distribution in vivo. For example, the blood-brain barrier (BBB) excludes many highly hydrophilic compounds. To ensure that the therapeutic protein crosses the BBB (if desired), it can be formulated, for example, in liposomes. For methods of manufacturing liposomes, see, e.g., U.S. Pat. Nos. 4,522,811; 5,374,548; and 5,399,331. The liposomes may include one or more moieties which are selectively transported into specific cells or organs, thus enhance targeted drug delivery (see, e.g., V. V. Ranade (1989) *J. Clin. Pharmacol.* 29:685).

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms can be dictated by and directly dependent on (a) the unique characteristics of the active compound and the particular therapeutic effect to be achieved, and (b) the limitations inherent in the art of compounding such an active compound for the treatment of sensitivity in individuals.

An exemplary, non-limiting range for a therapeutically or prophylactically effective amount of an antibody described herein is 0.1-20 mg/kg, more preferably 1-10 mg/kg. The target-binding antibody can be administered by intravenous infusion at a rate of less than 30, 20, 10, 5, or 1 mg/min to reach a dose of about 1 to 100 mg/m$^2$ or about 5 to 30 mg/m$^2$. For binding proteins smaller in molecular weight than an antibody, appropriate amounts can be proportionally less. It is to be noted that dosage values may vary with the type and severity of the condition to be alleviated. It is to be further understood that for any particular subject, specific dosage regimens should be adjusted over time according to the individual need and the professional judgment of the person administering or supervising the administration of the compositions, and that dosage ranges set forth herein are exemplary only and are not intended to limit the scope or practice of the claimed composition.

The pharmaceutical compositions may be prepared using a "therapeutically effective amount" or a "prophylactically effective amount" of an target-binding protein described herein. A "therapeutically effective amount" refers to an amount effective, at dosages and for periods of time necessary, to achieve the desired therapeutic result. A therapeutically effective amount of the composition may vary according to factors such as the disease state, age, sex, and weight of the individual, and the ability of the binding protein to elicit a desired response in the individual. A therapeutically effective amount is also one in which any toxic or detrimental effects of the composition are outweighed by the therapeutically beneficial effects. A "therapeutically effective dosage" preferably inhibits a measurable parameter, e.g., inflammation or tumor growth rate by at least about 20%, more preferably by at least about 40%, even more preferably by at least about 60%, and still more preferably by at least about 80% relative to untreated subjects. The ability of a compound to inhibit a measurable parameter, e.g., cancer, can be evaluated in an animal model system predictive of efficacy in human tumors. Alternatively, this property of a composition can be evaluated by examining the ability of the compound to inhibit, such inhibition in vitro by assays known to the skilled practitioner.

A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

Also within the scope of the invention are kits including the binding protein that binds to Tie1, Tie2, or Ang and instructions for use, e.g., treatment, prophylactic, or diagnostic use. In one embodiment, the instructions for diagnostic applications include the use of the target-binding protein (e.g., antibody or antigen-binding fragment thereof, or other polypeptide or peptide) to detect Tie1, Tie2, or Ang, in vitro, e.g., in a sample, e.g., a biopsy or cells from a patient having an inflammatory disorder or a cancer or neoplastic disorder, or in vivo. In another embodiment, the instructions for therapeutic applications include suggested dosages and/or modes of administration in a patient with a cancer or neoplastic disorder. The kit can further contain at least one additional reagent, such as a diagnostic or therapeutic agent, e.g., a diagnostic or therapeutic agent as described herein, and/or one or more additional target-binding proteins, formulated as appropriate, in one or more separate pharmaceutical preparations.

In one embodiment, target binding proteins (such as the Tie1 antibodies described herein) can be produced from gene-based vectors, such as transgenes or via adenoviral delivery.

Stabilization and Retention

In one embodiment, a target-binding agent (e.g., a Tie1-binding protein, polypeptide, antibody, or aptamer described herein) is physically associated with a moiety that improves its stabilization and/or retention in circulation, e.g., in blood, serum, lymph, or other tissues.

For example, a target-binding agent can be associated with a polymer, e.g., a substantially non-antigenic polymers, such as polyalkylene oxides or polyethylene oxides. Suitable polymers will vary substantially by weight. Exemplary polymers include polymers having molecular number average weights ranging from about 200 to about 35,000, from about 1,000 to about 15,000, and 2,000 to about 12,500.

For example, an target-binding agent can be conjugated to a water soluble polymer, e.g., hydrophilic polyvinyl polymers, e.g. polyvinylalcohol and polyvinylpyrrolidone. A non-limiting list of such polymers include polyalkylene oxide homopolymers such as polyethylene glycol (PEG) or polypropylene glycols, polyoxyethylenated polyols, copolymers thereof and block copolymers thereof, provided that the water solubility of the block copolymers is maintained. Additional useful polymers include polyoxyalkylenes such as polyoxyethylene, polyoxypropylene, and block copolymers of polyoxyethylene and polyoxypropylene (Pluronics); polymethacrylates; carbomers; branched or unbranched polysaccharides which comprise the saccharide monomers D-mannose, D- and L-galactose, fucose, fructose, D-xylose, L-arabinose, D-glucuronic acid, sialic acid, D-galacturonic acid, D-mannuronic acid (e.g. polymannuronic acid, or alginic acid), D-glucosamine, D-galactosamine, D-glucose and neuraminic acid including homopolysaccharides and heteropolysaccharides such as lactose, amylopectin, starch, hydroxyethyl starch, amylose, dextrane sulfate, dextran, dextrins, glycogen, or the polysaccharide subunit of acid mucopolysaccharides, e.g. hyaluronic acid; polymers of sugar alcohols such as polysorbitol and polymannitol; heparin or heparon.

Other compounds can also be attached to the same polymer, e.g., a cytotoxin, a label, or another targeting agent, e.g., another target-binding agent or an unrelated agent. Mono-activated, alkoxy-terminated polyalkylene oxides (PAO's), e.g., monomethoxy-terminated polyethylene glycols (mPEG's); $C_{1-4}$ alkyl-terminated polymers; and bis-activated polyethylene oxides (glycols) can be used for crosslinking. See, e.g., U.S. Pat. No. 5,951,974.

In its most common form poly(ethylene glycol), PEG, is a linear or branched polyether terminated with hydroxyl groups and having the general structure:

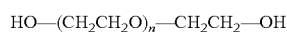

PEG can be synthesized by anionic ring opening polymerization of ethylene oxide initiated by nucleophilic attack of a hydroxide ion on the epoxide ring. Particularly useful for polypeptide modification is monomethoxy PEG, mPEG, having the general structure:

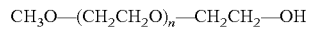

For further description, see, e.g., Roberts et al. (2002) *Advanced Drug Delivery Reviews* 54:459-476.

In one embodiment, the polymer prior to cross-linking need not be, but preferably is, water soluble. Generally, after crosslinking, the product is water soluble, e.g., exhibits a water solubility of at least about 0.01 mg/ml, and more preferably at least about 0.1 mg/ml, and still more preferably at least about 1 mg/ml. In addition, the polymer should not be highly immunogenic in the conjugate form, nor should it possess viscosity that is incompatible with intravenous infusion or injection if the conjugate is intended to be administered by such routes.

In one embodiment, the polymer contains only a single group which is reactive. This helps to avoid cross-linking of protein molecules. However, it is within the scope herein to maximize reaction conditions to reduce cross-linking, or to purify the reaction products through gel filtration or ion exchange chromatography to recover substantially homogenous derivatives. In other embodiments, the polymer contains two or more reactive groups for the purpose of linking multiple agents to the polymer backbone. Again, gel filtration or ion exchange chromatography can be used to recover the desired derivative in substantially homogeneous form.

The molecular weight of the polymer can range up to about 500,000 D, and preferably is at least about 20,000 D, or at least about 30,000 D, or at least about 40,000 D. The molecular weight chosen can depend upon the effective size of the conjugate to be achieved, the nature (e.g. structure, such as linear or branched) of the polymer, and the degree of derivatization.

The covalent crosslink can be used to attach a target-binding agent (e.g., a protein) to a polymer, for example, crosslinking to the N-terminal amino group and epsilon amino groups found on lysine residues, as well as other amino, imino, carboxyl, sulfhydryl, hydroxyl or other hydrophilic groups. The polymer may be covalently bonded directly to the target-binding protein without the use of a multifunctional (ordinarily bifunctional) crosslinking agent. Covalent binding to amino groups is accomplished by known chemistries based upon cyanuric chloride, carbonyl diimidazole, aldehyde reactive groups (PEG alkoxide plus diethyl acetal of bromoacetaldehyde; PEG plus DMSO and acetic anhydride, or PEG chloride plus the phenoxide of 4-hydroxybenzaldehyde, activated succinimidyl esters, activated dithiocarbonate PEG, 2,4,5-trichlorophenylcloroformate or P-nitrophenylcloroformate activated PEG.) Carboxyl groups can be derivatized by coupling PEG-amine using carbodiimide. Sulfhydryl groups can be derivatized by coupling to maleimido-substituted PEG (e.g. alkoxy-PEG amine plus sulfosuccinimidyl 4-(N-maleimidomethyl)cyclohexane-1-carboxylate) WO 97/10847 or PEG-maleimide commercially available from Shearwater Polymers, Inc., Huntsville, Ala.). Alternatively, free amino groups on the binding protein (e.g. epsilon amino groups on lysine residues) can be thiolated with 2-imino-thiolane (Traut's reagent) and then coupled to maleimide-containing derivatives of PEG, e.g., as described in Pedley et al., Br. J. Cancer, 70: 1126-1130 (1994).

Functionalized PEG polymers that can be attached to a target-binding agent (e.g., protein) are available, e.g., from Shearwater Polymers, Inc. (Huntsville, Ala.). Such commercially available PEG derivatives include, e.g., amino-PEG, PEG amino acid esters, PEG-hydrazide, PEG-thiol, PEG-succinate, carboxymethylated PEG, PEG-propionic acid, PEG amino acids, PEG succinimidyl succinate, PEG succinimidyl propionate, succinimidyl ester of carboxymethylated PEG, succinimidyl carbonate of PEG, succinimidyl esters of amino acid PEGs, PEG-oxycarbonylimidazole, PEG-nitrophenyl carbonate, PEG tresylate, PEG-glycidyl ether, PEG-aldehyde, PEG vinylsulfone, PEG-maleimide, PEG-orthopyridyl-disulfide, heterofunctional PEGs, PEG vinyl derivatives, PEG silanes, and PEG phospholides. The reaction conditions for coupling these PEG derivatives may vary depending on the Tie1-binding protein, the desired degree of PEGylation, and the PEG derivative utilized. Some factors involved in the choice of PEG derivatives include: the desired point of attachment (such as lysine or cysteine R-groups), hydrolytic stability and reactivity of the derivatives, stability, toxicity and antigenicity of the linkage, suitability for analysis, etc. Specific instructions for the use of any particular derivative are available from the manufacturer.

The conjugates of an target-binding agent (e.g., a Tie1 binding protein) and a polymer can be separated from the unreacted starting materials, e.g., by gel filtration or ion exchange chromatography, e.g., HPLC. Heterologous species of the conjugates are purified from one another in the same fashion. Resolution of different species (e.g., containing one or two PEG residues) is also possible, e.g., due to the difference in the ionic properties of unreacted amino acids. See, e.g., WO 96/34015.

A target binding protein can also be physically associated with a protein that provides a stabilizing or retention function, e.g., an albumin, e.g., human serum albumin. U.S. 20040171794 describes exemplary methods for physically associating a protein with serum albumin. For exemplary, human albumin sequences or fragments thereof, see EP 201 239, EP 322 094 WO 97/24445, WO95/23857 especially the mature form of human albumin as shown in SEQ ID NO:18 of U.S. 20040171794 and WO 01/79480 or albumin from other vertebrates or fragments thereof, or analogs or variants of these molecules or fragments thereof. Other exemplary human serum albumin proteins can include one or both of the following sets of point mutations Leu-407 to Ala, Leu-408 to Val, Val-409 to Ala, and Arg-410 to Ala; or Arg-410 to Ala, Lys-413 to Gln, and Lys-414 to Gln (see, e.g., International Publication No. WO95/23857, with reference to SEQ ID NO:18 of U.S. 20040171794).

Aptamers

In one embodiment, the invention also features target protein-binding agents such as aptamers. The term nucleic acid "aptamer," as used herein, refers to a nucleic acid molecule which has a conformation that includes an internal non-duplex nucleic acid structure of at least 5 nucleotides. An aptamer can be a single-stranded nucleic acid molecule which has regions of self-complementarity. Exemplary aptamers include nucleic acid molecules that bind to a target molecule other than a nucleic acid, e.g., to Tie1, Tie2, or Ang. Particular aptamers may also modulate formation of a Tie complex or have one or more properties of a target binding agent described herein and can be used in place of a target binding protein.

Aptamers can be screened in vitro since a selected aptamer can be recovered by standard nucleic acid amplification procedures. The method can be enhanced, e.g., in later rounds of selection, by splitting selected aptamers into pools and modifying each aptamer in the pool with a detectable label such as a fluorophore. Pools having aptamers that functionally alter the properties of the label can be identified. Such pools can be repeatedly split and reanalyzed to identify the individual aptamers with the desired properties (see, e.g., Jhaveri et al. *Nature Biotechnol.* 18:1293).

In addition, aptamers can be screened for activity in vivo. For example, shuffled nucleic acids can be cloned into an expression vector that is introduced into cells. RNA aptamers resulting from the expressed shuffled nucleic acids can be screened for a biological activity. Cells having the activity can be isolated and the expression vector for the selected RNA aptamer recovered.

An important feature of therapeutic oligomers (e.g., aptamers) is the design of the backbone of the administered oligomer. In some embodiments, the backbone contains internucleoside linkages that are stable in vivo and is structured such that the oligomer is resistant to endogenous nucleases, such as nucleases that attack the phosphodiester linkage. At the same time, the oligomer retains its ability to hybridize to the target DNA or RNA (Agarwal, K. L. et al. (1979) *Nucleic Acids Res.* 6:3009; Agarwal, S. et al. (1988) *Proc. Natl. Acad. Sci USA* 85:7079). Modified oligonucleotides can be constructed using alternate internucleoside linkages. Several of these exemplary linkages are described in Uhlmann, E. and Peyman, A. (1990) *Chemical Reviews* 90:543-584. Among these are methylphosphonates (wherein one of the phosphorus-linked oxygens has been replaced by methyl); phosphorothioates (wherein sulphur replaces one of these oxygens) and various amidates (wherein $NH_2$ or an organic amine derivative, such as morpholidates or piperazidates, replace an oxygen). These substitutions confer enhanced stability. WO 91/15500 teaches various oligonucleotide analogs in which one or more of the internucleotide linkages are replaced by a sulfur based linkage, typically sulfamate diesters, which are isosteric and isoelectric with the phosphodiester. WO 89/12060 similarly discloses linkages containing sulfides, sulfoxides, and sulfones. WO 86/05518 suggests a variant of stereoregular polymeric 3',5'linkages. U.S. Pat. No. 5,079,151 discloses a msDNA molecule of branched RNA linked to a single strand DNA via a 2',5' phosphodiester linkage. U.S. Pat. No. 5,264,562 describes modified linkages of the formula —Y'CX'$_2$Y'— wherein Y' is independently O or S and wherein each X' is a stabilizing substituent and independently chosen. Morpholino-type internucleotide linkages are described in U.S. Pat. No. 5,034,506 and in some cases give rise to an increased affinity of the oligomer for complementary target sequences. U.S. Pat. Nos. 5,264,562 5,596,086 disclose modified oligonucleotides having modified nucleoside linkages which are capable of strong hybridization to target RNA and DNA.

Treatments

Binding agents that bind to Tie1, Tie2, or Ang have therapeutic and prophylactic utilities. For example, these binding agents can be administered to cells in culture, e.g. in vitro or ex vivo, or can be administered to a subject, e.g., in vivo, to treat, prevent, and/or diagnose a variety of disorders, such as endothelial cell disorders, blood vessel development disorders, wound healing, inflammatory diseases and cancers, particularly metastatic cancers. The term "treat" or "treatment" refers to the application or administration of an agent, alone or in combination with one or more other agents (e.g., a second agent) to a subject, e.g., a patient, e.g., a patient who has a disorder (e.g., a disorder as described herein), a symptom of a disorder or a predisposition for a disorder, e.g., to cure, heal, alleviate, relieve, alter, remedy, ameliorate, improve or affect the disorder, the symptoms of the disorder or the predisposition toward the disorder. Treating a cell refers to a reduction in an activity of a cell, e.g., ability of an endothelial cell to form tubes or vessels. A reduction does not necessarily require a total elimination of activity, but a reduction, e.g., a statistically significant reduction, in the activity or the number of the cell.

As used herein, an amount of a target binding agent effective to treat a disorder, or a "therapeutically effective amount" refers to an amount of the binding agent which is effective, upon single or multiple-dose administration to a subject, in treating a cell, e.g., an endothelial cell (e.g., a Tie1-expressing endothelial cell) or cancer cell (particularly a metastatic cell thereof), or in prolonging curing, alleviating, relieving or improving a subject with a disorder as described herein beyond that expected in the absence of such treatment. In some cases, a therapeutically effective amount can be ascertained by evaluating the ability of the binding agent to reduce tumor size of a xenograft in a nude mouse model relative to an untreated control mouse. As used herein, "inhibiting the growth" of a tumor or other neoplasm refers to slowing, interrupting, arresting or stopping its growth and metastases and does not necessarily indicate a total elimination of the neoplastic growth.

As used herein, an amount of an target-binding agent effective to prevent a disorder, or a "a prophylactically effective amount" of the binding agent refers to an amount of a target binding agent, e.g., a Tie1-binding protein, e.g., a Tie1-binding antibody described herein, which is effective, upon single- or multiple-dose administration to the subject, for preventing or delaying the occurrence of the onset or recurrence of a disorder, e.g., an endothelial cell-related disorder, a blood vessel development disorder, an inflammatory disease or a cancer.

Subjects that can be treated include human and non-human animals. For example, the human can be a human patient having a disorder characterized by abnormal cell proliferation or cell differentiation. The term "non-human animals" includes all vertebrates, e.g., non-mammals (such as chickens, amphibians, reptiles) and mammals, such as non-human primates, sheep, dog, cow, pig, etc.

A binding agent described herein can be used to reduce angiogenesis in a subject, e.g., to treat a cancer (e.g., a solid tumor) or an angiogenesis-associated disorder. The method includes administering the binding to the subject, e.g., in an amount effective to modulate angiogenesis, a symptom of the disorder, or progression of the disorder. The agent (e.g., a Tie1-binding protein, e.g., an anti-Tie1 antibody, e.g., E3) may be administered multiple times (e.g., at least two, three, five, or ten times) before a therapeutically effective amount is attained.

The binding agent, e.g., a Tie1 binding protein, can be used to treat or prevent cancer. In one embodiment, reduction in Tie1 activity by a Tie1-binding protein can reduce or prevent angiogenesis near and around the tumor, thereby reducing or preventing tumor growth. In another embodiment, the neoplasia includes endothelial or hematopoietic cells that are proliferating abnormally. A Tie1-binding protein can be used to modulate the cells of a cancer themselves, e.g., to kill or ablate a neoplastic cell that expresses Tie1. For example, the cell is a hematopoietic cell.

Examples of cancers that can be treated include, but are not limited to, solid tumors, soft tissue tumors, and metastatic lesions. Examples of solid tumors include malignancies, e.g., sarcomas, adenocarcinomas, and carcinomas, of the various organ systems, such as those affecting lung, breast, lymphoid, gastrointestinal (e.g., colon), and genitourinary tract (e.g., renal, urothelial cells), pharynx, prostate, ovary as well as adenocarcinomas which include malignancies such as most colon cancers, rectal cancer, renal-cell carcinoma, liver cancer, non-small cell carcinoma of the lung, cancer of the small intestine and so forth. Metastatic lesions of the aforementioned cancers can also be treated or prevented using the Tie1 binding proteins and other agents described herein.

Still further examples of solid tumors that can be treated include: fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, gastrointestinal system carcinomas, colon carcinoma, pancreatic cancer, breast cancer, genitourinary system carcinomas, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, endocrine system carcinomas, testicular tumor, lung carcinoma, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, and retinoblastoma.

A Tie1-binding protein can also be used to inhibit the proliferation of hyperplastic/neoplastic cells of hematopoietic origin, e.g., cells arising from myeloid, lymphoid or erythroid lineages, or precursor cells thereof, particularly such cells that express Tie1. For instance, the binding proteins described herein can be used for the treatment of various myeloid disorders including, but not limited to, acute promyeloid leukemia (APML), acute myelogenous leukemia (AML) and chronic myelogenous leukemia (CML) (reviewed in Vaickus, L. (1991) *Crit Rev. in Oncol./Hemotol.* 11:267-97). Lymphoid malignancies which may be treated include, but are not limited to acute lymphoblastic leukemia (ALL), which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas include non-Hodgkin's lymphoma and variants thereof, peripheral T-cell lymphomas, adult T-cell leukemia/lymphoma (ATL), cutaneous T-cell lymphoma (CTCL), large granular lymphocytic leukemia (LGF) and Hodgkin's disease. As Tie1 has been shown to be upregulated in acute myelogenous leukemia and myelodysplastic syndrome (Verstovsek et al., 2001, Leuk, Lymphoma), B cell chronic lymphocytic leukemia (Aguayo et al, 2001. Leukemia Research 25(4):279-85.), binding proteins that interact with Tie1 can be used to detect, treat, or prevent these diseases.

Accordingly, a subject having or at risk for a hematopoietic disorder, e.g., a hematopoietic cancer, can be treated by administering a Tie1 binding protein, e.g. a Tie1 binding protein that increases Tie1 homodimerization, or a binding protein that antagonizes Tie complex formation. For example, the Tie1 binding protein can be an anti-Tie1 antibody, e.g., an antibody described herein. The administration of the binding protein can include multiple administrations, e.g., to achieve a therapeutic concentration using more than one dose. For example, the administrations can be about once a week, every second or third day, etc.

Methods of administering Tie1-binding proteins and other agents are also described in "Pharmaceutical Compositions". Suitable dosages of the molecules used will depend on the age and weight of the subject and the particular drug used. The binding proteins can be used as competitive agents to inhibit, reduce an undesirable interaction, e.g., between a natural or pathological agent and the Tie1.

In one embodiment, the Tie1-binding proteins are used to inhibit (e.g., inhibit at least one activity of, reduce proliferation, migration, growth or viability) of a cell, e.g., an endothelial cell in vivo. The binding proteins can be used by themselves or conjugated to an agent, e.g., a cytotoxic drug, cytotoxin enzyme, or radioisotope. This method includes: administering the binding protein alone or attached to a cytotoxic drug, to a subject requiring such treatment.

Since the Tie1-binding proteins recognize Tie1-expressing endothelial cells and can bind to endothelial cells that are associated with (e.g., in proximity of or intermingled with) cancer cells, e.g., cancerous lung, liver, colon, breast, ovarian, epidermal, laryngeal, and cartilage cells, and particularly metastatic cells thereof, Tie1-binding proteins can be used to inhibit (e.g., inhibit at least one activity, reduce growth and proliferation, or kill) any such cells and inhibit angiogenesis. Reducing endothelial cell activity near a cancer can indirectly inhibit (e.g., inhibit at least one activity, reduce growth and proliferation, or kill) the cancer cells which may be dependent on the endothelial cells for nutrients, growth signals and so forth.

Alternatively, the binding proteins bind to cells in the vicinity of the cancerous cells, but are sufficiently close to the cancerous cells to directly or indirectly inhibit (e.g., inhibit at least one activity, reduce growth and proliferation, or kill) the cancers cells. Thus, the Tie1-binding proteins (e.g., modified with a toxin, e.g., a cytotoxin) can be used to selectively inhibit (e.g., kill or ablate cells in cancerous tissue (including the cancerous cells themselves and endothelial cells associated with or invading the cancer).

The binding proteins may be used to deliver a variety of cytotoxic drugs including therapeutic drugs, a compound emitting radiation, molecules of plants, fungal, or bacterial origin, biological proteins, and mixtures thereof. The cytotoxic drugs can be intracellularly acting cytotoxic drugs, such as toxins short-range radiation emitters, e.g., short-range, high-energy α-emitters.

To kill or ablate normal, benign hyperplastic, or cancerous cells, a first binding protein is conjugated with a prodrug which is activated only when in close proximity with a prodrug activator. The prodrug activator is conjugated with a second binding protein, preferably one which binds to a non-competing site on the target molecule. Whether two binding proteins bind to competing or non-competing binding sites can be determined by conventional competitive binding assays. Exemplary drug-prodrug pairs are described in Blakely et al., (1996) *Cancer Research*, 56:3287-3292.

The Tie1-binding proteins can be used directly in vivo to eliminate antigen-expressing cells via natural complement-dependent cytotoxicity (CDC) or antibody-dependent cellular cytotoxicity (ADCC). The binding proteins described herein can include complement binding effector domain, such as the Fc portions from IgG1, -2, or -3 or corresponding portions of IgM which bind complement. In one embodiment, a population of target cells is ex vivo treated with a binding agent described herein and appropriate effector cells. The treatment can be supplemented by the addition of complement or serum containing complement. Further, phagocytosis of target cells coated with a binding protein described herein can be improved by binding of complement proteins. In another embodiment target, cells coated with the binding protein which includes a complement binding effector domain are lysed by complement.

Use of the therapeutic methods described herein to treat cancers has a number of benefits. Tie1 expression may be induced in response to hypoxic signals that can arise within the interior of a tumor to stimulate changes in vasculature, including blood and lymphatic vessels so as to increase nutrient and oxygen supply to the tumor. Certain Tie1-binding antibodies (e.g., E3 and related antibodies) may be particularly effective because they can inhibit changes to tumor vasculature and may cause a decrease in intra-tumor pressure. These agents may also be well suited as therapeutics in situations in which conventional agents have difficulty in penetrating into a tumor. Furthermore, Tie1 binding proteins may leave hematopoiesis unaffected. Treatment can be effectively monitored with clinical parameters. Alternatively, these parameters can be used to indicate when such treatment should be employed.

A Tie1 binding protein, e.g. a Tie1 binding protein that increases Tie1 homodimerization, or a binding protein that antagonizes Tie complex formation can be administered to a subject to treat or prevent an inflammatory disorder, e.g., psoriasis or rheumatoid arthritis.

Psoriasis. Psoriasis is a chronic skin disease, characterized by scaling and inflammation. When psoriasis develops, typically patches of skin thicken, redden, and become covered with silvery scales, referred to as plaques. Psoriasis most often occurs on the elbows, knees, scalp, lower back, face, palms, and soles of the feet. The disease also may affect the fingernails, toenails, and the soft tissues inside the mouth and genitalia. About 10 percent of people with psoriasis have joint inflammation that produces symptoms of arthritis. Patients can be evaluated using a static Physician Global Assessment (sPGA), and receive a category score ranging from six categories between clear and very severe. The score is based on plaque, scaling, and erythema. The therapeutic methods herein can be used to achieve an improvement for at least one of these indicia.

Rheumatoid arthritis ("RA") is a chronic inflammatory disease that causes pain, swelling, stiffness, and loss of function, primarily the joints. RA frequently begins in the synovium, the membrane that surrounds a joint creating a protective sac. In many individuals suffering from RA, leukocytes infiltrate from the circulation into the synovium causing continuous abnormal inflammation (e.g., synovitis). Consequently, the synovium becomes inflamed, causing warmth, redness, swelling, and pain. The collagen in the cartilage is gradually destroyed, narrowing the joint space and eventually damaging bone. The inflammation causes erosive bone damage in the affected area. During this process, the cells of the synovium grow and divide abnormally, making the normally thin synovium thick and resulting in a joint that is swollen and puffy to the touch. RA can be assessed by a variety of clinical measures. Some exemplary indicia include the total Sharp score (TSS), Sharp erosion score, and the HAQ disability index. The therapeutic methods herein can be used to achieve an improvement for at least one of these indicia.

A Tie1 binding protein (e.g. a Tie1 binding protein that increases Tie1 homodimerization) or a binding protein that antagonizes Tie complex formation can be administered to a subject to treat or prevent a retinal disorder, e.g., a proliferative retinopathy, such as diabetic retinopathy, ischemic retinopathy, or retinopathy of prematurity; choroidal neovascularization; lens neovasculation; corneal neovascularization; iridial neovascularization; or conjunctival neovascularization. The binding protein can be used to reduce the risk of retinal detachment associated with pathological ocular neovascularization. In some cases, the binding protein is administered by subconjunctival administration.

Combination Therapies

Binding proteins described herein can be administered in combination with one or more of the other therapies for treating cancers, including, but not limited to: surgery; radiation therapy, and chemotherapy. For example, proteins that antagonize Tie complex formation or that modulate Tie signalling activity (including, e.g., proteins that promote Tie1 homodimerization and/or phosphorylation) can also be used in combination with other anti-cancer therapies, such as radiation therapy, chemotherapy, surgery, or administration of a second agent. For example, the second agent can be one that targets or negatively regulates the VEGF signaling pathway. Examples of this latter class include VEGF antagonists (e.g., anti-VEGF antibodies such as bevacizumab) and VEGF receptor antagonists (e.g., anti-VEGF receptor antibodies). One particularly combination includes bevacizumab. The combination can further include 5-FU and leucovorin, and/or irinotecan.

The term "combination" refers to the use of the two or more agents or therapies to treat the same patient, wherein the use or action of the agents or therapies overlap in time. The agents or therapies can be administered at the same time (e.g., as a single formulation that is administered to a patient or as two separate formulations administered concurrently) or sequentially in any order. Sequential administrations are administrations that are given at different times. The time between administration of the one agent and another agent can be minutes, hours, days, or weeks. The use of a Tie1 binding protein described herein can also be used to reduce the dosage of another therapy, e.g., to reduce the side-effects associated with another agent that is being administered, e.g., to reduce the side-effects of an anti-VEGF antibody such as bevacizumab. Accordingly, a combination can include administering a second agent at a dosage at least 10, 20, 30, or 50% lower than would be used in the absence of the Tie1 binding protein.

In addition, a subject can be treated for an angiogenesis-associated disorder by administering to the subject a first and second agent. For example, the first agent modulates early stage angiogenesis and the second agent modulates a subsequent stage of angiogenesis or also modulates early stage angiogenesis. The first and second agents can be administered using a single pharmaceutical composition or can be administered separately. In one embodiment, the first agent is a VEGF pathway antagonist (e.g., an inhibitor of a VEGF (e.g., VEGF-A, -B, or -C) or a VEGF receptor (e.g., KDR or VEGF receptor III (Flt4)) or a bFGF pathway antagonist (e.g., an antibody that binds to bFGF or a bFGF receptor). Other VEGF pathway antagonists are also described, herein and elsewhere. In one embodiment, the second agent inhibits or decreases assembly and stabilization of the blood vessels, disrupts maintenance of blood or lymphatic vessels, or alters distribution of lymphatic vessels in tumors. For example, the second agent comprises inhibits a Tie complex formation or promotes Tie1 homodimerization. For example, the second agent is a Tie1 binding protein described herein.

Once a tumor reaches a certain size (e.g., ~1-2 mm), the tumor requires new vasculature prior to increasing its mass. An early stage of tumor angiogenesis can include a signal from the tumor, e.g., secretion of VEGF, to stimulate the growth of new blood vessels from the host and infiltration of the tumor by the vessels. VEGF can, for example, stimulate proliferation of endothelial cells that are then assembled into blood vessels. A late stage of tumor angiogenesis can include a signal that leads to the assembly and stabilization of the blood vessels. This assembly and stabilization may involve interaction between the endothelial cells and the pericytes that surround the endothelial cells of the vessels. Tie1, for example, may play a role in the assembly and stabilization of the vessels and in maintaining the association between the pericytes and endothelial cells. Thus, an effective therapy to treat angiogenesis-related disorders can involve a combination of an agent that modulates an early stage angiogenesis (e.g., VEGF pathway antagonists, e.g., anti-VEGF (e.g., bevacizumab) or anti-VEGF receptor (e.g., anti-KDR) antibodies; or antagonists of other pro-angiogenic pathways, e.g., anti-bFGF antibodies or anti-bFGF receptor (e.g., anti-bFGF receptor-1, -2, -3) antibodies) and an agent that modulates a late stage of tumor angiogenesis (e.g., antagonists of Tie1 (e.g., anti-Tie1 antibodies (e.g., an antibody disclosed herein, e.g., an E3 antibody)), of Tie2 (e.g., anti-Tie2 antibodies), or of Angs (e.g., anti-Ang antibodies (e.g., anti-Ang2 antibodies) or anti-Ang2 peptides (e.g., inhibitory Ang2 peptides)). One or more of these agents can be used in combination. One or more of these agents may also be used in combination with other anti-cancer therapies, such as radiation therapy or chemotherapy.

Exemplary VEGF receptor antagonists include inhibitors of VEGF receptor tyrosine kinase activity. 4-[4-(1-Amino-1-methylethyl)phenyl]-2-[4-(2-morpholin-4-yl-ethyl)phenylamino]pyrimidine-5-carbonitrile (JNJ-17029259) is one of a structural class of 5-cyanopyrimidines that are orally available, selective, nanomolar inhibitors of the vascular endothelial growth factor receptor-2 (VEGF-R2). Additional examples include: PTK-787/ZK222584(Astra-Zeneca), SU5416, SU11248 (Pfizer), and ZD6474 ([N-(4-bromo-2-fluorophenyl)-6-methoxy-7-[(1-methylpiperidin-4-yl)methoxy]quinazolin-4-amine]). Still other agents that can be used in combination with Tie1-binding proteins are broad specificity tyrosine kinase inhibitors, e.g., SU6668. See, e.g., Bergers, B. et al. (2003) J. Clin. Invest. 111, 1287-1295.

The second agent or therapy can also be another anti-cancer agent or therapy. Nonlimiting examples of anti-cancer agents include, e.g., anti-microtubule agents, topoisomerase inhibitors, antimetabolites, mitotic inhibitors, alkylating agents, intercalating agents, agents capable of interfering with a signal transduction pathway, agents that promote apoptosis, radiation, and antibodies against other tumor-associated antigens (including naked antibodies, immunotoxins and radioconjugates). Examples of the particular classes of anti-cancer agents are provided in detail as follows: antitubulin/ antimicrotubule, e.g., paclitaxel, vincristine, vinblastine, vindesine, vinorelbin, taxotere; topoisomerase I inhibitors, e.g., irinotecan, topotecan, camptothecin, doxorubicin, etoposide, mitoxantrone, daunorubicin, idarubicin, teniposide, amsacrine, epirubicin, merbarone, piroxantrone hydrochloride; antimetabolites, e.g., 5-fluorouracil (5-FU), methotrexate, 6-mercaptopurine, 6-thioguanine, fludarabine phosphate, cytarabine/Ara-C, trimetrexate, gemcitabine, acivicin, alanosine, pyrazofurin, N-Phosphoracetyl-L-Asparate=PALA, pentostatin, 5-azacitidine, 5-Aza 2'-deoxycytidine, ara-A, cladribine, 5-fluorouridine, FUDR, tiazofurin, N-[5-[N-(3,4-dihydro-2-methyl-4-oxoquinazolin-6-ylmethyl)-N-methylamino]-2-thenoyl]-L-glutamic acid; alkylating agents, e.g., cisplatin, carboplatin, mitomycin C, BCNU=Carmustine, melphalan, thiotepa, busulfan, chlorambucil, plicamycin, dacarbazine, ifosfamide phosphate, cyclophosphamide, nitrogen mustard, uracil mustard, pipobroman, 4-ipomeanol; agents acting via other mechanisms of action, e.g., dihydrolenperone, spiromustine, and desipeptide; biological response modifiers, e.g., to enhance anti-tumor responses, such as interferon; apoptotic agents, such as actinomycin D; and anti-hormones, for example anti-estrogens such as tamoxifen or, for example antiandrogens such as 4'-cyano-3-(4-fluorophenylsulphonyl)-2-hydroxy-2-methyl-3'-(trifluoromethyl) propionanilide.

A combination therapy can include administering an agent that reduces the side effects of other therapies. The agent can be an agent that reduces the side effects of anti-cancer treatments. For example, the agent can be leucovorin.

Combination therapies that include administering a Tie1 binding protein or other binding protein described herein can also be used to treat a subject having or at risk for another angiogenesis related disorder (e.g., a disorder other than cancer, e.g., disorders that include undesired endothelial cell proliferation or undesirable inflammation, e.g., rheumatoid arthritis.

Diagnostic Uses

Binding proteins that bind to Tie1 (e.g., antibodies, e.g., an antibody described herein) have in vitro and in vivo diagnostic, therapeutic and prophylactic utilities.

In one aspect, the invention provides a diagnostic method for detecting the presence of a Tie1, in vitro (e.g., a biological sample, such as tissue, biopsy, e.g., a cancerous tissue) or in vivo (e.g., in vivo imaging in a subject). The method includes: (i) contacting a sample with Tie1-binding protein; and (ii) detecting formation of a complex between the Tie1-binding protein and the sample. The method can also include contacting a reference sample (e.g., a control sample) with the binding protein, and determining the extent of formation of the complex between the binding protein and the sample relative to the same for the reference sample. A change, e.g., a statistically significant change, in the formation of the complex in the sample or subject relative to the control sample or subject can be indicative of the presence of Tie1 in the sample. The Tie1-binding protein can be directly or indirectly labeled with a detectable substance to facilitate detection of the bound or unbound antibody. Suitable detectable substances include various enzymes, prosthetic groups, fluorescent materials, luminescent materials and radioactive materials.

Complex formation between the Tie1-binding protein and Tie1 can be detected by measuring or visualizing either the binding protein bound to the Tie1 or unbound binding protein. Conventional detection assays can be used, e.g., an enzyme-linked immunosorbent assays (ELISA), a radioimmunoassay (RIA) or tissue immunohistochemistry. Further to labeling the Tie1-binding protein, the presence of Tie1 can be assayed in a sample by a competition immunoassay utilizing standards labeled with a detectable substance and an unlabeled Tie1-binding protein. In one example of this assay, the biological sample, the labeled standards and the Tie1 binding agent are combined and the amount of labeled standard bound to the unlabeled binding protein is determined. The amount of Tie1 in the sample is inversely proportional to the amount of labeled standard bound to the Tie1 binding agent.

Fluorophore and chromophore labeled binding proteins can be prepared. Since antibodies and other proteins absorb light having wavelengths up to about 310 nm, the fluorescent moieties should be selected to have substantial absorption at wavelengths above 310 nm and preferably above 400 nm. A variety of suitable fluorescers and chromophores are described by Stryer (1968) Science, 162:526 and Brand, L. et al. (1972) Annual Review of Biochemistry, 41:843-868. The binding proteins can be labeled with fluorescent chromophore groups by conventional procedures such as those disclosed in U.S. Pat. Nos. 3,940,475, 4,289,747, and 4,376,110. One group of fluorescers having a number of the desirable properties described above is the xanthene dyes, which include the fluoresceins and rhodamines. Another group of fluorescent compounds are the naphthylamines. Once labeled with a fluorophore or chromophore, the binding protein can be used to detect the presence or localization of the Tie1 in a sample, e.g., using fluorescent microscopy (such as confocal or deconvolution microscopy).

Histological Analysis. Immunohistochemistry can be performed using the binding proteins described herein. For example, in the case of an antibody, the antibody can synthesized with a label (such as a purification or epitope tag), or can be detectably labeled, e.g., by conjugating a label or label-binding group. For example, a chelator can be attached to the antibody. The antibody is then contacted to a histological preparation, e.g., a fixed section of tissue that is on a microscope slide. After an incubation for binding, the preparation is washed to remove unbound antibody. The preparation is then analyzed, e.g., using microscopy, to identify if the antibody bound to the preparation. The method can be used to evaluate an endothelial cell or tissue formed by endothelial cells, e.g., blood vessels. The antibody (or other polypeptide or peptide) can be unlabeled at the time of binding. After binding and washing, the antibody is labeled in order to render it detectable.

Protein Arrays. The Tie1-binding protein can also be immobilized on a protein array. The protein array can be used as a diagnostic tool, e.g., to screen medical samples (such as isolated cells, blood, sera, biopsies, and the like). Of course, the protein array can also include other binding proteins, e.g., that bind to Tie1 or to other target molecules, such as hyaluronic acid.

Methods of producing polypeptide arrays are described, e.g., in De Wildt et al. (2000) Nat. Biotechnol. 18:989-994; Lueking et al. (1999) Anal. Biochem. 270:103-111; Ge (2000) Nucleic Acids Res. 28, e3, I-VII; MacBeath and Schreiber (2000) Science 289:1760-1763; WO 01/40803 and WO 99/51773A1. Polypeptides for the array can be spotted at high speed, e.g., using commercially available robotic apparati. The array substrate can be, for example, nitrocellulose, plastic, glass, e.g., surface-modified glass. The array can also include a porous matrix, e.g., acrylamide, agarose, or another polymer.

For example, the array can be an array of antibodies, e.g., as described in De Wildt, supra. Cells that produce the binding proteins can be grown on a filter in an arrayed format. Polypeptide production is induced, and the expressed polypeptides are immobilized to the filter at the location of the cell. A protein array can be contacted with a labeled target to determine the extent of binding of the target to each immobilized polypeptide. If the target is unlabeled, a sandwich method can be used, e.g., using a labeled probed, to detect binding of the unlabeled target. Information about the extent of binding at each address of the array can be stored as a profile, e.g., in a computer database. The protein array can be produced in replicates and used to compare binding profiles, e.g., of a target and a non-target.

FACS. (Fluorescent Activated Cell Sorting). The target-binding protein can be used to label cells, e.g., cells in a sample (e.g., a patient sample). The binding protein can also be attached (or attachable) to a fluorescent compound. The cells can then be sorted using fluorescent activated cell sorted (e.g., using a sorter available from Becton Dickinson Immunocytometry Systems, San Jose Calif.; see also U.S. Pat. Nos. 5,627,037; 5,030,002; and 5,137,809). As cells pass through the sorter, a laser beam excites the fluorescent compound while a detector counts cells that pass through and determines whether a fluorescent compound is attached to the cell by detecting fluorescence. The amount of label bound to each cell can be quantified and analyzed to characterize the sample.

The sorter can also deflect the cell and separate cells bound by the binding protein from those cells not bound. The separated cells can be cultured and/or characterized.

In Vivo Imaging. In still another embodiment, the invention provides a method for detecting the presence of a Tie1-expressing cancerous tissues in vivo. The method includes: administering the Tie1-binding protein to a subject; and detecting the Tie1-binding protein in the subject. The detecting can include determining location or time of formation of the complex. The method can include scanning or otherwise imaging the subject, e.g., a region of the subject's body. Another method includes (i) administering to a subject (e.g., a patient having a cancer or neoplastic disorder) a Tie1-binding antibody, conjugated to a detectable marker; (ii) exposing the subject to a means for detecting said detectable marker to the Tie1-expressing tissues or cells. For example, the method can be used visualize blood vessels or the location of endothelial cells, e.g., Tie1-expressing endothelial cells. The subject can be imaged, e.g., by NMR or other tomographic means.

Examples of labels useful for diagnostic imaging include radiolabels such as $^{131}$I, $^{111}$In, $^{123}$I, $^{99m}$Tc, $^{32}$P, $^{125}$I, $^{3}$H, $^{14}$C, and $^{188}$Rh, fluorescent labels such as fluorescein and rhodamine, nuclear magnetic resonance active labels, positron emitting isotopes detectable by a positron emission tomography ("PET") scanner, chemiluminescers such as luciferin, and enzymatic markers such as peroxidase or phosphatase. Short-range radiation emitters, such as isotopes detectable by short-range detector probes can also be employed. The binding protein can be labeled with such reagents using known techniques. For example, see Wensel and Meares (1983) *Radioimmunoimaging and Radioimmunotherapy*, Elsevier, New York for techniques relating to the radiolabeling of antibodies and D. Colcher et al. (1986) *Meth. Enzymol.* 121: 802-816.

A radiolabeled binding protein can also be used for in vitro diagnostic tests. The specific activity of an isotopically-labeled protein depends upon the half-life, the isotopic purity of the radioactive label, and how the label is incorporated into the protein.

Effective imaging agents for tumor-associated neo-vasculature are needed. Tie1 is up regulated on tumor-associated vasculature. The binding proteins described herein can be used to image such vasculature. The binding proteins described herein can be used for imaging in several ways. A binding protein can be physically associated, e.g., coupled to a chelator for imaging agents such as $^{99m}$Tc, $^{186}$Re, or $^{188}$Re. $^{99m}$Tc and $^{188}$Re emit gamma rays suitable for single photon emission computer tomography (SPECT) imaging. Radioactive fluorine ($^{18}$F), indium ($^{111}$In), iodine ($^{123}$I, $^{131}$I), gallium ($^{68}$Ga, $^{67}$Ga), carbon ($^{11}$C), thallium ($^{201}$Tl), and other elements may be used as imaging agents.

The binding proteins can also be attached, covalently or non-covalently, to a particle, e.g., a nano-particle, that includes a radionuclide or spin labels suitable for use as an imaging agent. The binding proteins can be linked to a spin label that would allow imaging through MRI. Botnar et al. (*Circulation*. (2004) 109:2023-2029.) describe MRI imaging using an exemplary gadolinium-labeled peptide. The binding proteins described herein can be similarly labeled for imaging.

Chen et al. (*J. Nucl. Med.*, (2004) 45:1776-1783) showed that coupling a small PEG molecule (average molecular weight 3.4 KDa) improved that pharmacodynamics of an $\alpha_v\beta_3$-binding peptide. Binding proteins (e.g., Tie1, Tie2, or Ang binding proteins) can be coupled to PEG molecules to adjust the clearance rate and pathway.

Positron Emission Tomography (PET) can be used with imaging agents such as positron emitters such as $^{64}$Cu and $^{18}$F. These isotopes are becoming more readily available. $^{64}$Cu can be captured in the chelator DOTA. DOTA derivatives can be covalently linked to proteins. In one embodiment, one or more DOTA derivatives are attached to a binding protein (e.g., a Fab) through a lysine side group.

Fabs are useful binding agents for imaging because they: a) clear from the system fairly raipdly, allowing imaging within a few hours of injection, and b) penetrate tumors efficiently.

Fabs that bind to Tie1, Tie2, or Ang can be produced, e.g., in *E. coli* or in eukaryotic cells. The Fabs can be purified by chromatography over protein A. Ion exchange chromatography can also be used. For use in imaging, covalent attachment of a chelating group suitable to the desired radionuclide or other imaging agent allows the Fab to be labeled at the time of use. The Fabs can also have spin labels attached to allow MRI imaging. Fabs can also be attached to particles (e.g., nanoparticles) that include a radionuclide or spin label suitable for imaging. In particular embodiments, Fabs may be coupled to PEG molecules to adjust the rate and pathway of clearance. In other embodiments, the Fabs are not coupled to PEG, e.g., to maintain their rapid clearance properties.

Procedures for labeling polypeptides with the radioactive isotopes (such as $^{14}$C, $^{3}$H, $^{35}$S, $^{125}$I, $^{32}$P, $^{131}$I) are generally known. For example, tritium labeling procedures are described in U.S. Pat. No. 4,302,438. Iodinating, tritium labeling, and $^{35}$S labeling procedures, e.g., as adapted for murine monoclonal antibodies, are described, e.g., by Goding, J. W. (*Monoclonal antibodies: principles and practice: production and application of monoclonal antibodies in cell biology, biochemistry, and immunology* 2nd ed. London; Orlando: Academic Press, 1986. pp 124-126) and the references cited therein. Other procedures for iodinating polypeptides, such as antibodies, are described by Hunter and Greenwood (1962) *Nature* 144:945, David et al. (1974) *Biochemistry* 13:1014-1021, and U.S. Pat. Nos. 3,867,517 and 4,376,110. Radiolabeling elements which are useful in imaging include $^{123}$I, $^{131}$I, $^{111}$In, and $^{99m}$Tc, for example. Procedures for iodinating antibodies are described by Greenwood, F. et al. (1963) *Biochem. J.* 89:114-123; Marchalonis, J. (1969) *Biochem. J.* 113:299-305; and Morrison, M. et al. (1971) *Immunochemistry* 289-297. Procedures for $^{99m}$Tc-labeling are described by Rhodes, B. et al. in Burchiel, S. et al. (eds.), *Tumor Imaging: The Radioimmunochemical Detection of Cancer*, New York: Masson 111-123 (1982) and the references cited therein. Procedures suitable for $^{111}$In-labeling antibodies are described by Hnatowich, D. J. et al. (1983) *J. Immul. Methods,* 65:147-157, Hnatowich, D. et al. (1984) *J. Applied Radiation,* 35:554-557, and Buckley, R. G. et al. (1984) *F.E.B.S.* 166:202-204.

In the case of a radiolabeled binding protein, the binding protein is administered to the patient, is localized to the tumor bearing the antigen with which the binding protein reacts, and is detected or "imaged" in vivo using known techniques such as radionuclear scanning using e.g., a gamma camera or emission tomography. See e.g., A. R. Bradwell et al., "Developments in Antibody Imaging", *Monoclonal Antibodies for Cancer Detection and Therapy*, R. W. Baldwin et al., (eds.), pp 65-85 (Academic Press 1985). Alternatively, a positron emission transaxial tomography scanner, such as designated Pet VI located at Brookhaven National Laboratory, can be used where the radiolabel emits positrons (e.g., $^{11}$C, $^{18}$F, $^{15}$O, and $^{13}$N).

MRI Contrast Agents. Magnetic Resonance Imaging (MRI) uses NMR to visualize internal features of living subject, and is useful for prognosis, diagnosis, treatment, and surgery. MRI can be used without radioactive tracer compounds for obvious benefit. Some MRI techniques are summarized in EP-A-0 502 814. Generally, the differences related to relaxation time constants T1 and T2 of water protons in different environments are used to generate an image. However, these differences can be insufficient to provide sharp high resolution images.

The differences in these relaxation time constants can be enhanced by contrast agents. Examples of such contrast agents include a number of magnetic agents paramagnetic agents (which primarily alter T1) and ferromagnetic or superparamagnetic (which primarily alter T2 response). Chelates (e.g., EDTA, DTPA and NTA chelates) can be used to attach (and reduce toxicity) of some paramagnetic substances (e.g., $Fe^{+3}$, $Mn^{+2}$, $Gd^{+3}$). Other agents can be in the form of particles, e.g., less than 10 µm to about 10 nM in diameter). Particles can have ferromagnetic, antiferromagnetic or superparamagnetic properties. Particles can include, e.g., magnetite ($Fe_3O_4$), $\gamma$-$Fe_2O_3$, ferrites, and other magnetic mineral compounds of transition elements. Magnetic particles may include: one or more magnetic crystals with and without nonmagnetic material. The nonmagnetic material can include synthetic or natural polymers (such as sepharose, dextran, dextrin, starch and the like The target-binding proteins can also be labeled with an indicating group containing of the NMR-active $^{19}F$ atom, or a plurality of such atoms inasmuch as (i) substantially all of naturally abundant fluorine atoms are the $^{19}F$ isotope and, thus, substantially all fluorine-containing compounds are NMR-active; (ii) many chemically active polyfluorinated compounds such as trifluoracetic anhydride are commercially available at relatively low cost, and (iii) many fluorinated compounds have been found medically acceptable for use in humans such as the perfluorinated polyethers utilized to carry oxygen as hemoglobin replacements. After permitting such time for incubation, a whole body MRI is carried out using an apparatus such as one of those described by Pykett (1982) *Scientific American,* 246:78-88 to locate and image cancerous tissues.

Information obtained from evaluating an target-binding protein, e.g., a binding protein described herein, can be recorded on machine-compatible media, e.g., computer readable or computer accessible media. The information can be stored as a computer representation, e.g., in a database (e.g., in the case of imaging using a binding protein, a database of images for one or a plurality of subjects). The term "computer representation" refers to information which is in a form that can be manipulated by a computer. The act of storing a computer representation refers to the act of placing the information in a form suitable for manipulation by a computer.

Also within the scope of the invention are kits including the binding protein that binds to Tie1 and instructions for diagnostic use, e.g., the use of the target-binding protein (e.g., antibody or antigen-binding fragment thereof, or other polypeptide or peptide) to detect Tie1, in vitro, e.g., in a sample, e.g., a biopsy or cells from a patient having a cancer or neoplastic disorder, or in vivo, e.g., by imaging a subject. The kit can further contain a least one additional reagent, such as a label or additional diagnostic agent. For in vivo use the binding protein can be formulated as a pharmaceutical composition.

The following examples are not to be construed as limiting.

EXAMPLES

Example 1

Tie1 Sequences

An exemplary Tie1 amino acid sequence (SEQ ID NO:2) is as follows:

```
MVWRVPPFLLPILFLASHVGAAVDLTLLANLRLTDPQRFFLTCVSGEAGAGRGSDAWGPP

LLLEKDDRIVRTPPGPPLRLARNGSHQVTLRGFSKPSDLVGVFSCVGGAGARRTRVIYVH

NSPGAHLLPDKVTHTVNKGDTAVLSARVHKEKQTDVIWKSNGSYFYTLDWHEAQDGRFLL

QLPNVQPPSSGIYSATYLEASPLGSAFFRLIVRGCGAGRWGPGCTKECPGCLHGGVCHDH

DGECVCPPGFTGTRCEQACREGRFGQSCQEQCPGISGCRGLTFCLPDPYGCSCGSGWRGS

QCQEACAPGHFGADCRLQCQCQNGGTCDRFSGCVCPSGWHGVHCEKSDRIPQILNMASEL

EFNLETMPRINCAAAGNPFPVRGSIELRKPDGTVLLSTKAIVEPEKTTAEFEVPRLVLAD

SGFWECRVSTSGGQDSRRFKVNVKVPPVPLAAPRLLTKQSRQLVVSPLVSFSGDGPISTV

RLHYRPQDSTMDWSTIVVDPSENVTLMNLRPKTGYSVRVQLSRPGEGGEGAWGPPTLMTT

DCPEPLLQPWLEGWHVEGTDRLRVSWSLPLVPGPLVGDGFLLRLWDGTRGQERRENVSSP

QARTALLTGLTPGTHYQLDVQLYHCTLLGPASPPAHVLLPPSGPPAPRHLHAQALSDSEI

QLTWKHPEALPGPISKYVVEVQVAGGAGDPLWIDVDRPEETSTIIRGLNASTRYLFRMRA

SIQGLGDWSNTVEESTLGNGLQAEGPVQESRAAEEGLDQQLILAVVGSVSATCLTILAAL

LTLVCIRRSCLHRRRTFTYQSGSGEETILQFSSGTLTLTRRPKLQPEPLSYPVLEWEDIT

FEDLIGEGNFGQVIRAMIKKDGLKMNAAIKMLKEYASENDHRDFAGELEVLCKLGHHPNI

INLLGACKNRGYLYIAIEYAPYGNLLDFLRKSRVLETDPAFAREHGTASTLSSRQLLRFA

SDAANGMQYLSEKQFIHRDLAARNVLVGENLASKIADFGLSRGEEVYVKKTMGRLPVRWM

AIESLNYSVYTTKSDVWSFGVLLWEIVSLGGTPYCGMTCAELYEKLPQGYRMEQPRNCDD

EVYELMRQCWRDRPYERPPFAQIALQLGRMLEARKAYVNMSLFENFTYAGIDATAEEA
```

An exemplary nucleic acid sequence (SEQ ID NO:1) that encodes Tie1 is as follows:

```
atggtctggc gggtgccccc tttcttgctc cccatcctct tcttggcttc tcatgtgggc    60
gcggcggtgg acctgacgct gctggccaac ctgcggctca cggaccccca gcgcttcttc   120
ctgacttgcg tgtctgggga ggccggggcg ggaggggct cggacgcctg ggcccgccc    180
ctgctgctgg agaaggacga ccgtatcgtg cgcaccccgc ccgggccacc cctgcgcctg   240
gcgcgcaacg gttcgcacca ggtcacgctt cgcggcttct ccaagccctc ggacctcgtg   300
ggcgtcttct cctgcgtggg cggtgctggg gcgcggcgca cgcgcgtcat ctacgtgcac   360
aacagccctg gagcccacct gcttccagac aaggtcacac acactgtgaa caaaggtgac   420
accgctgtac tttctgcacg tgtgcacaag gagaagcaga cagacgtgat ctggaagagc   480
aacggatcct acttctacac cctggactgg catgaagcca aggatgggcg gttcctgctg   540
cagctcccaa atgtgcagcc accatcgagc ggcatctaca gtgccactta cctggaagcc   600
agcccctgg gcagcgcctt ctttcggctc atcgtgcggg gttgtggggc tgggcgctgg   660
gggccaggct gtaccaagga gtgcccaggt tgcctacatg gaggtgtctg ccacgaccat   720
gacggcgaat gtgtatgccc ccctggcttc actggcaccc gctgtgaaca ggcctgcaga   780
gagggccgtt ttgggcagag ctgccaggag cagtgcccag gcatatcagg ctgccggggc   840
ctcaccttct gcctcccaga cccctatggc tgctcttgtg atctggctg gagaggaagc   900
cagtgccaag aagcttgtgc ccctggtcat tttggggctg attgccgact ccagtgccag   960
tgtcagaatg gtggcacttg tgaccggttc agtggttgtg tctgcccctc tgggtggcat  1020
ggagtgcact gtgagaagtc agaccggatc ccccagatcc tcaacatggc tcagaactg  1080
gagttcaact tagagacgat gccccggatc aactgtgcag ctgcagggaa ccccttcccc  1140
gtgcggggca gcatagagct acgcaagcca gacggcactg tgctcctgtc caccaaggcc  1200
attgtggagc cagagaagac cacagctgag ttcgaggtgc cccgcttggt tcttgcggac  1260
agtgggttct gggagtgccg tgtgtccaca tctggcggcc aagacagccg gcgcttcaag  1320
gtcaatgtga aagtgccccc cgtgccctg gctgcacctc ggctcctgac caagcagagc  1380
cgccagcttg tggtctcccc gctggtctcg ttctctgggg atggacccat ctccactgtc  1440
cgcctgcact accggcccca ggacagtacc atggactggt cgaccattgt ggtggacccc  1500
agtgagaacg tgacgttaat gaacctgagg ccaaagacag gatacagtgt tcgtgtgcag  1560
ctgagccggc caggggaagg aggagagggg gcctgggggc ctcccaccct catgaccaca  1620
gactgtcctg agcctttgtt gcagccgtgg ttggagggct ggcatgtgga aggcactgac  1680
cggctgcgag tgagctggtc cttgcccttg gtgcccgggc cactggtggg cgacggtttc  1740
ctgctgcgcc tgtgggacgg gacacggggg caggagcggc gggagaacgt ctcatccccc  1800
caggcccgca ctgccctcct gacgggactc acgcctggca cccactacca gctggatgtg  1860
cagctctacc actgcaccct cctgggcccg gcctcgcccc ctgcacacgt gcttctgccc  1920
cccagtgggc ctccagcccc cgacacctc cacgcccagg ccctctcaga ctccgagatc  1980
cagctgacat ggaagcaccc ggaggctctg cctgggccaa tatccaagta cgttgtggag  2040
gtgcaggtgc ctggggtgc aggagaccca ctgtggatag acgtggacag gcctgaggag  2100
acaagcacca tcatccgtgg cctcaacgcc agcacgcgct acctcttccg catgcgggcc  2160
agcattcagg ggctcgggga ctggagcaac acagtagaag agtccaccct gggcaacggg  2220
ctgcaggctg agggcccagt ccaagagagc cgggcagctg aagagggcct ggatcagcag  2280
```

```
                                           -continued
ctgatcctgg  cggtggtggg  ctccgtgtct  gccacctgcc  tcaccatcct  ggccgccctt  2340
ttaaccctgg  tgtgcatccg  cagaagctgc  ctgcatcgga  gacgcacctt  cacctaccag  2400
tcaggctcgg  gcgaggagac  catcctgcag  ttcagctcag  ggaccttgac  acttacccgg  2460
cggccaaaac  tgcagcccga  gcccctgagc  tacccagtgc  tagagtggga  ggacatcacc  2520
tttgaggacc  tcatcgggga  ggggaacttc  ggccaggtca  tccgggccat  gatcaagaag  2580
gacgggctga  agatgaacgc  agccatcaaa  atgctgaaag  agtatgcctc  tgaaaatgac  2640
catcgtgact  ttgcgggaga  actggaagtt  ctgtgcaaat  tggggcatca  ccccaacatc  2700
atcaacctcc  tgggggcctg  taagaaccga  ggttacttgt  atatcgctat  tgaatatgcc  2760
ccctacggga  acctgctaga  ttttctgcgg  aaaagccggg  tcctagagac  tgacccagct  2820
tttgctcgag  agcatgggac  agcctctacc  cttagctccc  ggcagctgct  gcgtttcgcc  2880
agtgatgcgg  ccaatggcat  gcagtacctg  agtgagaagc  agttcatcca  cagggacctg  2940
gctgcccgga  atgtgctggt  cggagagaac  ctagcctcca  agattgcaga  cttcggcctt  3000
tctcggggag  aggaggttta  tgtgaagaag  acgatgggc   gtctccctgt  gcgctggatg  3060
gccattgagt  ccctgaacta  cagtgtctat  accaccaaga  gtgatgtctg  gtcctttgga  3120
gtccttcttt  gggagatagt  gagccttgga  ggtacaccct  actgtggcat  gacctgtgcc  3180
gagctctatg  aaaagctgcc  ccagggctac  cgcatggagc  agcctcgaaa  ctgtgacgat  3240
gaagtgtacg  agctgatgcg  tcagtgctgg  cgggaccgtc  cctatgagcg  accccccttt  3300
gcccagattg  cgctacagct  aggccgcatg  ctggaagcca  ggaaggccta  tgtgaacatg  3360
tcgctgtttg  agaacttcac  ttacgcgggc  attgatgcca  cagctgagga  ggcctga     3417
```

Example 2

Selection and Primary Screening

We have used phage display to select Tie1-specific antibodies from a very large phage library that displays immunoglobulins as Fab fragments. To isolate antibodies specific to Tie1, a phage displayed Fab antibody library was selected against the Tie1 extracellular domain fused to human Fc or to a histidine purification tag.

Selection in solution was done using biotin labelled antigen which was captured on streptavidin coated magnetic beads (M–280-DYNAL®). Selection on cells expressing Tie1 was performed using a KINGFISHER™ automated magnetic bead capture device. Selection on immobilized antigen was performed using Tie1-Fc coated onto immunotubes. Several selection strategies were used:

Strategy 1: Round 1 (500 mM biotin labelled Tie1/magnetic beads), Round 2 (1×10⁷ Tie1 expressing cells/Kingfisher), Round 3 (1×10⁷ Tie1 expressing cells/Kingfisher)

Strategy 2: Round 1 (500 mM biotin labelled Tie1/magnetic beads), Round 2 (1×10⁷ Tie1 expressing cells/KINGFISHER™), (300 mM biotin labelled Tie1/magnetic beads)

Strategy 3: Round 1 (Tie1 Fc coated immunotubes at 5 µg/ml), Round 2 (Tie1-Fc coated immunotubes), Round 3 (Tie1 Fc coated immunotubes plus depletion with human IgG).

Library members recovered from the selection strategies were tested for antigen binding in phage ELISA. Each isolate was tested for binding to coated Tie1 Fc. Strategy 1 did not identify any binding clones whereas strategy 2 identified 13 positive clones (n=95). Strategy 3 identified 86 binding clones (n=95).

Sequence analysis of the selected clones were grouped on the basis of the CDR3 selected of the heavy chain and resulted in 23 different antibodies with unique VH-CDR3 sequences.

We reformatted the selected Fabs as completely human antibodies by recloning the VH and VL coding sequences from the display library vector into two vectors of a mammalian expression vector system. These vectors contain the human kappa constant domain and the human gamma-1 heavy chain constant region. The vectors were co-transfected into mammalian CHO-K1 cells for expression and production of the corresponding complete IgGs. These antibodies were characterized using several assays as described below, including: 1. Western blotting and immunoprecipitation of Tie1 transfected cells and primary human endothelial cells; 2. Immunofluorescence of Tie1 transfected cells and primary human endothelial cells; 3. Stimulation and inhibition of Tie1 in BaF3 cells and primary human endothelial cells; and 4. Immunostaining of human tissues.

We identified 23 antibodies that interact with Tie1. See FIGS. 7-36. After sequence confirmation of the reformatted clones they were used in a transient transfection of HEK293T cells. After growth the IgG was purified from culture supernatants using a protein A column. The quality of purified IgG1 was determined using SDS-PAGE.

The specificity of the Tie1 specific IgG's can be determined in a whole cell ELISA on mouse lung microvascular endothelial cells (LEII) and LEII-Tie1 cells transfected with a Tie1 expression construct. Cells are seeded into 96 well plates at a density of 10,000 cells/well and were fixed using 4% paraformaldehyde. Staining and detection of binding of IgG1 to LEII cells are detected using standard labelling with a HRP conjugated rabbit anti human HRP and TMB staining. Binding of purified IgG1 to LEII-Tie1 transfected cells can also be corrected for Tie1 protein that is expressed endogenously. Alternatively cells that have little or no endogenous Tie1 can be used for the analysis.

At least one of the binding antibodies—E3—functions as a Tie1 activating antibody in the BaF3 cell bioassay. We studied Tie1 phosphorylation in response to E3 IgG treatment in transiently transfected COS1 cells and human primary endothelial cells. Our results indicate that E3 IgG activates the Tie1 receptor. The BaF3 cell bioassay (also referred to as the "Tie1/EpoR chimericBAF cell assay" may provide an indication of a ligand's ability to cross-link the Tie1 receptor. Because the assay is artificial, crosslinking of the non-naturally occurring Tie-Epo fusion proteins may or may not be predictive of a ligand's ability to modulate in vivo function.

E3 can be used, instead of possible natural ligands to characterize several functions of Tie1 in vitro and in vivo. The region of Tie1 which interacts with E3 can be the target for small molecular weight compounds for Tie1 activation or inhibition.

Although E3 functions in one particular Tie1 activating assay, E3 and other positives in this assay may also have inhibitory effect as to other functions or in other contexts. For example, E3 can inhibit tube formation by HUVEC cells. See below.

In addition, we found two antibodies that inhibit the survival effect conferred by E3 in the BaF3 cell bioassay. These two antibodies may inhibit dimerization of Tie1 induced by E3 in the BaF3 assay. Two antibodies, B2 and D11, completely blocked the viability of Tie1/EpoR cells when used in combination with E3.

Methods

Cell culture. COS1 cells were cultured in Dulbecco's modified Eagle's medium (DMEM) supplemented with 10% fetal calf serum (FCS), glutamine and antibiotics. The murine BaF3 pre-B lymphocytes were cultured in DMEM supplemented with 10% FCS, glutamine, antibiotics and 2 ng/ml interleukin-3 (Calbiochem). Human dermal microvascular endothelial cells (HDMVECs), obtained from PromoCell (Heidelberg, Germany) were cultured in endothelial cell medium provided by the supplier and used at passages 4-7.

Western blotting and immunoprecipitation. COS1 cells were transfected with pcDNA3-Tie1-V5 (1 μg DNA per 10 cm cell culture plate) using FUGENE 6 (Roche) according to manufacturer's instruction and incubated for 48 h before stimulation. For immunoprecipitation, Tie1 transfected cells and HMVEC cells were lysed in DOC-RIPA lysis buffer (50 mM Tris-HCl pH 8.0, 150 mM NaCl, 1% Triton-X-100, 0.1% SDS, 1% DOC, 10 mM EDTA) supplemented with aprotinin, leupeptin, PMSF and sodium vanadate. Immunoprecipitation was carried out from equal amount of cell lysates by incubating with polyclonal anti-human Tie1 antibodies (R&D), monoclonal anti-V5 antibodies (Invitrogen) or altogether 23 anti-Tie1 antibodies (1 μg/ml) for 1 to 2 h followed by incubation with protein G-Sepharose (Amersham Pharmacia Biotech AB) for 1 h. The immunoprecipitates were washed twice with PBS-T and twice with PBS, followed by elution with the Laemmli buffer and separation in 8% SDS-PAGE. The blots were probed with the 23 anti-Tie1 antibodies (5 μg/ml) and subsequently anti-human Fc antibodies conjugated with HRP.

Immunofluorescence staining. COS1 cells on the glass coverslips were transiently transfected with pcDNA3-Tie1-V5 (the V5-epitope was added to the 3' terminus of pcDNA3-Tie1) (1 μg DNA per 10 cm cell culture plate) using FUGENE™ 6 (Roche) according to manufacturer's instruction and incubated for 48 h before staining. Cells were fixed in 4% paraformaldehyde for 10 min at 4° C. If required, the cells were permeabilized with 0.2% Triton X-100 in PBS for 5 min. Unspecific binding sites were blocked by incubation with 1% BSA in PBS for 30 min. The cells were then stained with anti-Tie1 antibodies (5 μg/ml) and anti-V5 antibodies for 1 h at room temperature, followed by incubation with FITC-conjugated anti-human antibodies (DAKO, 40 μg/ml) and TRITC-conjugated anti-mouse antibodies (DAKO, 15 μg/ml) for 30 min. Hoechst 33258 fluorochrome (Sigma, 0.5 μg/ml) was used for the staining of the nuclei.

BaF3 bioassay. To generate Tie1-EpoR expressing BaF3 cells for the bioassay, BaF3 pre-B cells were stably transfected with a nucleic acid that expresses chimeric receptor containing the extracellular domain of human Tie1 fused with the transmembrane and cytoplasmic domains of the mouse erythropoietin receptor. The nucleic acid used was a Tie1-EpoR chimeric cDNA in a pEF-BOS expression vector. The nucleic acid encoding the chimeric receptor was constructed by cloning the PCR amplified extracellular part of human Tie1 (bp 37-2316 of X60975) as EcoRI-BglII fragment into mEpoR-pcDNA vector. The cDNA encoding for the chimeric receptor consisting of the extracellular part of Tie1 fused with the transmembrane and intracellular domains of EpoR was subcloned into the pEF-BOS expression vector. Vector was linearized and co-transfected into BaF3 cells with pcDNA3.1 (+) Zeo vector (Invitrogen). Stable cell pools were generated by selection with 250 μg/ml Zeocin. The expression of Tie1/EpoR fusion protein in several clones was analyzed by Western blotting with an antibody against EpoR.

To perform the assays, BaF3 cells expressing the Tie1-EpoR chimera were split in 96-well microtiter plates at 50 000 cells/well in the presence of the indicated concentrations of anti-Tie1 antibodies. The E3 antibody used in this study was the germ-lined E3 antibody (DX-2220). As controls, Zeocin resistant pools not expressing the Tie1-EpoR were used. After 48 h, the viability of the cells was determined by adding MTT (3-(4,5-dimethylthiazol-2-yl)-2,5-diphenyl tetrazolium bromide (Sigma), 0.5 mg/ml), followed by further 2 h of culture, addition of an equal volume of cell lysis solution (10% SDS, 10 mM HCl) and incubation overnight at 37° C. Absorbance was measured at 540 nm.

Tie1 phosphorylation assay. COS1 cells were transfected with pcDNA3-Tie1-V5. After 24 h of transfection, the cells were serum starved for 8 h and then treated with E3 IgG. For the Tie1 phosphorylation assay, HDMVECs were cultured on 10 cm dishes to near confluence, starved (8-16 h) in serum free medium and stimulated as indicated. After the stimulations, the cells were lysed in lysis buffer (RIPA-DOC: 50 mM Tris-HCl pH 8.0, 150 mM NaCl, 1% Triton-X-100, 0.1% SDS, 0.5% DOC, 10 mM EDTA, supplemented with aprotinin, leupeptin, PMSF and sodium vanadate). Clarified lysates from transfected COS1 cells or HDMVECs were immunoprecipitated with anti-V5 or anti-Tie1 B9, respectively. Proteins were separated by SDS-PAGE, transferred to nitrocellulose and immunoblotted using the anti-phosphotyrosine and anti-Tie1 (R&D systems) antibodies.

Immunostaining of human tissues. To evaluate reactivity of anti-Tie1 antibodies in immunohistochemistry, 5 μm cryosections of human kidney and lung were dried at room temperature for 30 min and fixed with cold acetone for 10 min. Slides were washed with PBS and treated with 0.03% $H_2O_2$ in PBS for 15 min to reduce endogenous peroxidase activity. TNB (30 min at room temperature) was used to block non-specific binding and sections were incubated with Tie1 antibodies at concentration of 10 μg/ml overnight at +4° C. After several washings with PBS, biotinylated anti human antibody (1:300, Zymed) was added to the tissues. Signal was amplified by using a TSA kit and detected with AEC staining.

Results

Western blotting, immunoprecipitation and immunofluorescence of Tie1 transfected cells and primary human endothelial cells (see Table 1).

TABLE 1

Assay Summary

| Clone | WB: Tie1-transfected | WB: HDMEC | IP: Tie1-transfected | IP: HDMEC | IF: Tie1-transfected | IF: HDMEC | BaF3 assay |
|---|---|---|---|---|---|---|---|
| E3    | + | + | ND | −    | +    | +  | + |
| G2    | + | + | ++ | +    | +    | ++ | − |
| A2    | + | + | ++ | +    | +    | ++ | − |
| A10   | + | + | ++ | +    | +    | +  | − |
| B2    | + | + | +  | −    | +    | +  | − |
| B9    | + | + | ++ | ++   | ++   | +  | − |
| C2    | + | + | ++ | ++   | +    | ++ | − |
| C7    | + | + | ++ | +    | +    | +  | − |
| C10   | + | + | ++ | ++   | ++   | +  | − |
| D11   | + | + | +  | −    | +    | ++ | − |
| E11   | + | + | ++ | +    | +    | ++ | − |
| G10   | + | + | ++ | +    | ++   | +  | − |
| H1    | + | + | ++ | +    | ++   | +  | − |
| H4    | + | + | ++ | +    | +    | +  | − |
| P-A1  | + | + | ++ | ++   | +    | ++ | − |
| P-A10 | + | + | ++ | −    | +    | +  | − |
| P-B1  | + | + | +  | −    | weak | +  | − |
| P-B3  | + | + | −  | −    | +    | +  | − |
| P-C6  | + | + | +  | −    | +    | ++ | − |
| P-D12 | + | + | +  | −    | +    | +  | − |
| P-F3  | + | + | −  | −    | ++   | ++ | − |
| P-F4  | + | + | ++ | −    | cross| ++ | − |
| P-G3  | + | + | ++ | +    | +    | +  | − |
| PH1   | − | − | −  | −    | −    | −  | − |

To confirm the binding ability of the 23 selected anti-Tie1 antibodies, we first performed western blotting and immunoprecipitation using COS1 cells transfected with pcDNA3-Tie1-V5 (V5 tagged) and primary endothelial cells. Next, to find out if the anti-Tie1 antibodies recognize Tie1 in living cells, those cells were studied by immunofluorescence staining. All the antibodies analyzed recognized both transfected and endogenous Tie1, although differences were detected in the binding affinity as shown in Table 1.

Stimulation and inhibition of Tie1 in Tie1-EpoR transfected BaF3 cells and human primary endothelial cells. Although no ligand for Tie1 has been identified, we used the following efficient screening method for Tie1-binding proteins. Interleukin-3 dependent pre-B-lymphocyte (BaF3) cells were transfected with a construct that expresses a Tie1-EpoR fusion protein. Since BaF3 cells are IL-3 dependent, they die unless IL-3 is provided. However, Tie-EpoR receptor expressing BaF3 cells can survive and proliferate if the medium contains a Tie1-binding protein, either a natural ligand or an artificial mimetic. Cell survival can be quantitated, e.g., by colorimetric MTT-assay, which measures mitochondrial activity.

The results from the BaF3 cell assays indicated that, of the 23 different monoclonal antibodies tested, only E3 IgG was able to promote survival of Tie1-EpoR cells whereas the viability of EpoR BaF3 cells used as a control was not affected by E3 IgG. The IgG part of the immunoglobulin molecule was needed for the survival effect of E3 IgG, as the E3 Fab fragment had no effect on the viability of Tie1-EpoR cells. A concentration of 50 ng/ml of E3 IgG gave almost maximal viability in Tie1-EpoR cell survival assays and the viability was dose dependent.

To test if the E3 IgG binding to the extracellular region of Tie1 induces autophosphorylation of Tie1, the Tie1 receptor phosphorylation level in response to E3 IgG treatment was studied in transiently transfected COS1 cells and human primary endothelial cells. COS1 cells were transfected with an expression vector containing a V5-tagged full length Tie1 cDNA, and, after serum starvation, the cells were treated with E3 IgG (200 ng/ml). Cell lysates were extracted at several time points and Tie1 was immunoprecipitated with anti-V5 followed by western blotting using anti-phosphotyrosine and anti-Tie1 antibodies. The results indicated that Tie1 is tyrosine phosphorylated after 10 to 30 min of E3 IgG stimulation. To determine if E3 IgG induces Tie1 phosphorylation in primary endothelial cells, HDMVEC cells were serum starved and stimulated with several concentrations of E3 for 60 min. Tie1 was then immunoprecipitated from cell lysates and subjected to anti-phosphotyrosine blotting analysis, which showed receptor phosphorylation following E3 IgG stimulation at 50-200 ng/ml. Also higher concentrations of E3 (500-1000 ng/ml) induced Tie1 phosphorylation but the response was more rapid and was most prominent after 5 min of stimulation.

To study the kinetics of E3 IgG induced Tie1 activation, cells were stimulated with E3 IgG (200 ng/ml) and receptor phosphorylation was studied at various time points. Tie1 phosphorylation was highest 15-30 min after E3 IgG treatment but phosphorylation persisted for up to 1 h.

To determine if any of the other monoclonal antibodies tested inhibit the survival effect of E3 IgG in Tie1-EpoR BaF3 assay, antibodies were studied in combination with E3 IgG. A concentration of 100 ng/ml of E3 IgG together with 100 (1:1) or 500 (1:5) ng/ml of the other antibodies were used and the viability of Tie1-EpoR cells was measured. The results from both combinations of E3 IgG and the test antibody (in 1:1 and 1:5 ratios) were similar and indicated that two of the 23 antibodies (B2 and D11) blocked completely the survival effect of E3 IgG. Several antibodies (A2, A10, P-B1, P-B3 and P-C6) inhibited the viability effect of E3 IgG to some extent and two of the antibodies (G2 and C7) promoted the survival of Tie1/EpoR BaF3 cells in combination with E3 IgG.

Immunostaining of human tissues. The anti-Tie1 antibodies react with human Tie1 in cultured cells. It is also possible to determine whether they could stain human tissue samples from lung and kidney as well as from tumors by using biotinylated anti-Tie1 antibodies and detecting bound antibodies using labeled streptavidin or avidin.

Example 3

Exemplary Sequences

Sequences of exemplary immunoglobulin variable domains are shown in FIGS. 7-36.

Example 4

Inhibition of Tube Formation by HUVEC Cells Using Anti Tie1 E3-IgG

To demonstrate the ability of E3 to inhibit angiogenesis in vitro, purified E3 was tested for its ability to inhibit tube formation by human umbilical cord endothelial cells (HUVECS). Human Umbilical vein endothelial cells (HUVEC) were obtained by treating fresh human umbilical cord veins with Trypsin-EDTA (1×) (Gibco/Invitrogen) for 20-25 minutes at 37° C. The cells were cultured in a T-25 flask coated with attachment factor (AF), (Cascade Biologics) in RPMI 1640 medium supplemented with 10% FCS, 0.4% BBE, 1% 1-glutamin, 1% penicillin/streptomycin. Primary cultures were detached with warm Trypsin-EDTA and used when confluent at the second or third passage. The cells were maintained in a proliferative state by culturing them in a split ratio 1:2 at an approximate density of the monolayer of about 60-80%. To dissociate the cells, HUVEC monolayers were treated with trypsin/EDTA (500 µl/dish) at 37° C. for 3 min. Trypsin activity was stopped by adding 3 volumes of complete RPMI medium. The cells were carefully scraped, separated by repeated pipetting, and finally washed with PBS.

After 2 passages HUVECs were seeded in their culture medium ($40 \times 10^3/50$ µl/well of a 96-well plate) on a collagen gel (50 µl of collagen 11.5 mg/ml) prepared by mixing 7.5 volumes of 2 mg/ml collagen (Collagen R; Serva, Heidelberg, Germany), 1 volume of 10×MEM, 1.5 volume of $NaHCO_3$ (15.6 mg/ml) and ~1 volume of NaOH to adjust the pH to 7.4. After 1.5 h, the culture medium was then discarded and the cells were covered with a new layer of collagen (1.5 mg/ml, new preparation, 50 µl/well). After polymerization of the gel, culture medium was added to each well in presence or in absence of E3 antibody (1 ng/ml to 10 µg/ml). The assay was performed with a streptavidin antibody used as a control (from 1 ng/ml to 10 µg/ml). The total length of the tube network on the culture surface was quantified at 40× magnification by the METAVUE™ Software (Universal Imaging Corporation). Results from triplicate wells were expressed as mean vessel area per field±SEM (relative units). Each assay was performed at least three times.

E3 is a potent inhibitor of tube formation by HUVECS even at a concentration of 10 ng/ml. The control anti-streptavidin has no effect on the ability of HUVECS to form tubes. This results indicates that E3 can inhibit at least one aspect of angiogenesis.

Example 5

Immunohistochemical Analysis of E3 Binding to Matched Tumor and Normal Tissue Sections To evaluate the binding of E3 to Tie1 in primary tumor and normal tissue the antibody was produced as an IgG and biotin labeled. The E3 antibody and two other anti Tie1 antibodies B2 and D11 were reformatted as full length IgG molecules. Nucleic acids encoding these IgGs were transiently transfected into HEK293T cells. Plasmid preparations for transient cell transfections were performed using the HP-GENELUTE™ MIDI prep kit (Sigma, cat. no. NA0200). HEK293T cells (GenHunter Corp. cat. no. Q401) were seeded 24 hours before transfection; $6 \times 10^6$ cells were plated per 10-cm culture dish. Transfections were carried out using LIPOFECTAMNE™ 2000 reagent (Invitrogen, cat. no. 11668019) following the manufacturer's instructions. Five micrograms of plasmid DNA was used per 10-cm dish. Cells were cultured in DMEM (Invitrogen, cat. no. 31966021) supplemented with 10% "ultra-low IgG" fetal calf serum (Invitrogen, cat. no. 16250078), at 37° C., 5% $CO_2$, in a water saturated atmosphere. Conditioned media were harvested 72 hours and 144 hours after transfection, pooled and sterile filtered.

One hundred microliters of Protein A beads (rprotein A Sepharose 4 Fast Flow, Amersham Biosciences, cat. no. 17-1279-01) equilibrated in PBS were added to the cell culture supernatants, and these were rotated overnight at 4° C., e.g., in 50 ml tubes. The beads were collected by centrifugation, transferred to a 96-well filter plate (UNI-FILTER 800 GF/B, Whatman, cat. no. 7700-2803) and washed extensively with PBS using a vacuum manifold (Macherey Nagel, cat. no. 760681). Elution of the antibodies was achieved by resuspending the beads in 400 µl of 12.5 mM citric acid. After a 30 to 60 second incubation, the bead eluates were collected, using the vacuum manifold, into the wells of a 96-well collection plate (UNIPLATE 750, Whatman, cat. no. 7701-5750). Each well of the collection plate contained 60 µl of 1 M HEPES pH 7.5 buffer to immediately neutralize the eluted fractions. The elution step was performed twice to maximize antibody recovery. The eluted samples were then dialyzed against PBS using dialysis cassettes (Slide-A-Lyser Dialysis Cassettes, MWCO 10,000, Pierce, cat. no. 66380) and protein concentration was determined from the absorbance at 280 nm assuming that a 1 mg/ml solution has an absorbance of 1.35. The quality of the preparations was analyzed by reducing and non-reducing SDS-PAGE.

The Tie1 antibodies were biotinylated using the EZ-link Sulfo-NHS-SS-Biotin (Pierce, Cat. 21331). For Tie1/Fc and Tie1-His, the reaction was performed for 2 hours on ice in 50 mM sodium carbonate buffer, pH 9.6, in the presence of a 5-fold molar excess of biotinylating agent. For the antibodies, the reaction was performed for 2 hours on ice in PBS, in the presence of a 15-fold molar excess of EZ-link Sulfo-NHS-SS-Biotin. The reaction was stopped by the addition of Tris-HCl, pH 7.5 (50 mM final concentration) followed by a 1-hour incubation on ice. Samples were then dialyzed against PBS.

Various normal and tumor tissue sections were stained with biotinylated antibodies. A mouse monoclonal anti-Tie1 antibody (7e8) (Alitalo laboratory, University of Helsinki) was used as a positive control. Sections without primary antibody served as negative control. All samples were fresh frozen tissues and staining was performed with the TSA-kit (Perkin-Elmer Life Sciences). After acetone fixation (10-20 min, −20° C.) the slides were treated with 0.73% $H_2O_2$ for 10 min to reduce endogenous peroxidase activity followed by blocking for 30 min with TNB buffer. Sections (5-10 mm thick) were incubated with primary antibodies (10 µg/ml) overnight at 4° C. Sections with the mouse monoclonal anti-tie1 antibody (7e8) were treated with biotinylated anti-mouse antibodies (VectaStain) before the addition of streptavidin-HRP. Signal was amplified by using a TSA kit and the visualized by AEC (235 ml NaAc, 15 ml AEC (stock solution: 1600 mg 3-amino-9-ethyl-carbazole and 480 ml N-dimethylformamide), 250 µl $H_2O_2$).

In general, Tie1 expression was upregulated in tumor tissue when compared with matching normal tissue. However, in the tumor tissues the anti Tie1 antibodies stained other structures in addition to the vessels. Furthermore, some tissue specificity in the expression of certain epitopes was observed. For example, the E3 antibody stained vessels in the lung and kidney but not in the skin while the B2 antibody stained vessels very faintly in other normal tissues than in the breast. Shedding of the ectodomain of Tie1 into the tumor tissues can explain observed differences.

In skin tissue, the E3, B2, and D11 antibodies stained blood vessels very faintly whereas the murine 7e8 control antibody gave a clear staining in the normal skin. In melanoma tissue, the 7e8 antibody stained vessels only but the E3, B2, and D11 antibodies also stained other surrounding structures. The staining pattern was similar with all three of the E3, B2, and D11 antibodies.

In lung tissue, we observed that the E3 antibody stained especially clearly the large veins in the lung, whereas D11 and 7e8 gave a faint staining. B2 did not stain the same veins. The expression of Tie1 was dramatically upregulated in lung carcinoma and all the antibodies stained vessels more strongly in samples with lung carcinoma than in samples from normal lung. In the lung tumors, the E3, B2, and D11 antibodies stained structures other than vessels.

In kidney, the E3 and D11 antibodies stained kidney tubules in addition to the vessels. B2 gave only very faint staining of either tubules or vessels while 7e8 stained only vessels. In hypernephroma tissue, only the E3 antibody gave a clear staining.

In breast, E3 gave the brightest staining in the veins and capillaries of the mammary tissue, B2 and 7e8 gave a similar staining while D11 stained those structures rather faintly. In breast carcinoma the Tie1 expression was substantially upregulated, and the E3, B2, and D11 antibodies stained also other structures in addition to vessels.

Example 6

Binding to Mouse Endothelial Cell Lines of Anti Tie1 E3-IgG Using Flow Cytometry We evaluated if E3 cross reacts with mouse Tie1 in situ and thus if we can evaluate E3 activity in mouse tumor xenograft models binding to mouse endothelial cells was tested and compared with human and transfected cell lines.

Specific binding of the Tie1 antibodies and of control Mabs to mouse endothelial cells was measured by flow cytometry analysis (FACSscan, Becton Dickinson, Oxnard, Epics, Coulter). Mouse endothelial cell lines MS1, Le-2, Bend3, SVEC (ATCC, Rockville) and Tie1 transfected Le-2 cells were stained. Cell staining was modified from existing protocols. About 200,000 cells were used in each experiment: after trypsinization, cells were washed one time in PBS and resuspended PBS, 10% heat inactivated human serum (incubation buffer). To test specificity, antibodies were incubated at different dilutions for 1 h at room temperature. Cells were spun down by centrifugation for 3 min at 611 g. Between incubations cells were washed twice with PBS. Then relevant biotinylated antibodies (A2 against streptavidin, E3 against Tie1, were added and incubated for 1 h at room temperature). The E3 DX-2210 antibody, in which the light chain has been germlined, was used for these studies. This was followed by incubation with Strepatvidin-R-phycoerythrin (Dako, Glostrup, Denmark) for 1 hour at room temperature in incubation buffer. After the final incubation step bound antibodies were detected by means of flow cytometry on a FACSCan and Epics Altra (Becton Dickinson, Oxnard, Coulter) and results analyzed.

Intracellular Tie1 was measured as described above, except for the addition of Saponin to the incubation buffer to a final concentration of 0.1% during incubations. The anti-Tie1 antibody E3 binds to mouse endothelial cell lines indicating a cross reactivity of E3 with mouse and human Tie1 in situ. The binding pattern in mouse cell lines detected by flow cytometry is different from the binding pattern in HUVEC in that in mouse cells there is a greater cell surface staining than that compared to primary human endothelial cell lines. DX-2210 stained positively both mouse endothelial cell lines as well as the HUVEC control cells. There was a shift in the fluorescent signal when the cells were treated with saponin, indicating a significant intracellular pool of sequestered Tie1.

Example 7

Determination of anti Tie1 E3-IgG Binding to Human Platelets Using Flow Cytometry Binding experiments with a purified polyclonal goat antiserum against Tie1 (R&D systems) had showed binding to human platelets in a previous study (Tsiamis et al., (2000) *J Vasc. Res.* 37:437-42). The conclusion form this study was that platelets represent a large pool of Tie1 immunoreactivity which could present a problem for development of Tie1 as a therapeutic target. To determine if the antibody E3 binds to platelets we performed flow cytometric analysis on both activated and inactivated platelets and compared the staining pattern with the purified anti Tie1 polyclonal serum.

To avoid platelet activation, human platelets were isolated from plasma of healthy donors using the platelet GelSep kit (Biocytex, Marseille, France) kit according to the guidelines of the manufacturer. Platelets were activated by the addition of thrombin to a final concentration of 0.8 U/ml. To distinguish activated from non-activated platelets double staining was performed with Tie1 antibodies/control antibodies and antibody CD42 (total platelets) or CD62 (activated platelets).

After preparation, platelets were resuspended in buffer 2 of the GelSep kit, 10% heat inactivated human serum (incubation buffer) and incubated for 1 hour. To test specificity, biotinylated antibodies human anti-Tie1 (E3), human antistreptavidin (A2-SV, an antibody that does not bind Tie1), human anti-FITC and goat anti-Tie (R&D systems) were incubated with 500 000 platelets per test for 1 hour at different dilutions (2 µg/ml, 10 µg/ml) for 1 h at room temperature. Platelets were spun down by centrifugation for 10 min at 611 g. Between incubations platelets were washed twice with Buffer 1 of the GelSep kit. Then, Strepatvidin-R-phycoerythrin together with anti-CD42-PercP or anti-CD62-PercP were incubated for 30 minutes at room temperature in incubation buffer After the last incubation and washing detection of bound antibodies was performed by means of flow cytometry on a FACSscan and Epics Altra (Becton Dickinson, Oxnard, Coulter,) and results analyzed. Cells were gated on SSC and anti-CD42-PercP for the total platelets in case non-activated platelets were used and on SSC and anti-CD62-PercP for the activated platelets.

The polyclonal goat anti-Tie1 antibody indeed binds to platelets under the conditions tested. This binding is lower when platelets are activated. In contrast, the human anti-Tie1 antibody E3 shows no significant binding to total platelets, nor to activated platelets (FIG. 1).

Example 10

Assessment of Tie1 Immunoreactivity in Human Platelets Using Immunoprecipitation with Anti Tie1 E3-IgG A previous study with a purified polyclonal goat antiserum against Tie1 (R&D Systems) had showed binding to human platelets (Tsiamis et al., 2000). The conclusion from this study was that platelets represent a large pool of Tie1 immunoreactivity which could present a problem for development of Tie1 as a therapeutic target. To exclude the possibility that the antibody E3 binds to platelets immunoprecipitation of lysates prepared from platelets and HUVECS were performed. Both activated and inactivated platelets were tested.

Anti-Tie1 antibodies B2, D11, E3, the goat polyclonal AF619 (R&D) and negative control antibodies anti-FITC and anti-Streptavidin were used. HUVECS were retrieved from culture dishes by trypsinization and platelets were prepared with the platelet GelSep kit (Biocytex, Marseille, France) kit according to the guidelines of the manufacturer. Per immunoprecipitation experiment 3-5×10$^6$ and 3×10$^8$ cells platelets were used for each antibody tested. Platelets and cells were washed with PBS and spun down at 1400 rpm for 4 minutes and supernatant was removed. Then cells were lysed in 1 ml lysis buffer containing 50 mM Tris HCL pH 7.5, 150 mM NaCl, 0.5% Deoxycholic acid (DOC) and 0.5% NP-40 for 5 minutes. The lysed cells were spin down for 10 minutes at 14.000 rpm and 5 µg/ml antibody was added to the supernatant and incubated at 4° C. on a rotator. 100 µl/sample protein A beads (Uppsala, Sweden) were washed 3 times with lysis buffer (centrifugation speed: 15 seconds, 2000 rpm) then cell lysates incubated with antibody were added for 30 minutes 4° C. Then beads were washed three times with washing buffer containing 50 mM Tris HCL pH 7.5, 400 mM NaCl, 0.5% DOC, 0.5% NP-40. Finally, beads are spun down and the pellets was resuspended in an equal amount in sample buffer to perform SDS-page and Western blotting. In Western blotting Tie1 was detected with the polyclonal goat anti-Tie1 antibody. The conclusions of this study are that E3 is able to immunoprecipitate Tie1 in HUVEC but not in platelets.

Example 8

Distribution of Tie1 in HUVEC Cells Determined by Staining with Anti Tie1 E3-IgG We analyzed the staining pattern of E3 in HUVECS using confocal microscopy. HUVEC were trypsinised, washed with PBS and spotted at a density of 60 000 cells on a gelatine coated microscope slide and incubated for 24 hours in a humidified incubator at 37° C. Cells were air dried and fixed with 4% paraformaldehyde for 20 minutes at room temperature. The slides were washed with PBS. The slides were incubated with 10% Heat inactivated human serum (incubation buffer).

For measuring specific binding to Tie1, biotinylated antibody E3 and biotinylated negative control antibody A2 were used at a concentration of 10 µg/ml and incubated for 1 hour at room temperature. Slides were washed twice with PBS. Then, Strepatvidin-R-phycoerythrin (Dako, Glostrup, Denmark) was added and incubated for 1 hour at room temperature. After the last incubation and washing detection of bound antibodies was performed by means of confocal microscopy.

E3 binds specifically to HUVEC as detected by confocal microscopy. The staining is pre-dominantly located inside of the cell which suggests a large intracellular pool of Tie1 relative to a smaller pool of cell surface localized Tie1. The localization of E3 was consistent with co-localization of Tie1 with a cytoskeletal protein.

Example 9

Conversion of Somatic Mutations Positioned in the Framework Region of Anti Tie1 E3 to Germline Residues To reduce potential immunogenicity of E3 in humans, all non germline amino acid residues in the LC framework regions were corrected back to germline. An initial analysis was performed which aligned the LC of E3 with a database containing all kappa and lambda light chain germline genes. The LC of E3 was shown to have closest homology to DPK4 and three substitutions in E3 relative to the germline framework regions were identified.

We constructed a germlined version of E3 in which the LC framework regions were altered to include sequences identical to the DPK4 germline framework regions. The germlined E3 antibody was constructed by engineering a nucleic acid encoding the desired sequence. Changes to nucleic acids encoding the E3 LC variable domain were made by PCR and other standard molecular biological techniques and verified by nucleic acid sequencing.

An exemplary germlined light chain variable domain E3 sequence includes: DIQMTQSP_SS_LSASVGDRVTITCRA-QGIGHYLAWYQQKPGKVPKLLIYTASTLQSGVP SRF-SGSGSGTDFTLTI_SS_LQPEDVATYYCQQFNSYPHTFG-QGTRL_E_IK (SEQ ID NO:159). The altered positions are underscored.

We produced the germlined version of the E3 antibody as both a soluble Fab and as an IgG. The Fab cassette of the positive sFAB-expressing clone was PCR amplified with oligonucleotides, ligated into a mammalian expression vector containing the human IgG4 Fc region and electroporated into XL1 Blue MRF' cells. The prokaryotic ribosomal binding sequence and gene three leader sequence were replaced with a mammalian internal ribosomal entry and heavy chain leader sequences. Reformatted antibody clones were sequenced to confirm accuracy following the cloning procedure. Endotoxin-free DNA was prepared and used for transient transfection studies.

Example 10

Production and Testing of Germlined Anti Tie1 E3-Fab for Binding to Recombinant Tie1-Fc in ELISA To evaluate if the conversion of any of the somatic mutations in the framework of E3 back to germline residues had any effect on binding activity the soluble Fabs were produced. The soluble expression vector containing the parental E3 Fab and the germlined E3 Fab construct were grown overnight at 30° C. in 2×TY broth containing 100 μg/ml ampicillin and 2% glucose and use 4 ml of this overnight culture to inoculate 400 ml of 2×TY broth containing 100 μg/ml ampicillin and 0.1% glucose. Cells were grow at 37° C. until an OD$_{600}$ of 0.8-1.0, 1 mM IPTG was added and the culture was maintained at 30° C. for 4 hours. The cultures were spun down at 4,000 rpm for 15 min at 4 C. The supernatants were discarded and resuspend the pellets resuspended in 4.8 ml of ice cold TES buffer (0.2 M Tris-HCl, 0.5 mM EDTA, 0.5 M sucrose, pH 8.0) containing proteases inhibitors (protease inhibitor cocktail tablets [Roche]: dissolve 1 tablet in 1 ml of water and dilute 50-times in TES buffer). Transfer to 50 ml Falcon tubes and place on ice for 5-10 min. During this incubation, wash the centrifugation bottles with 5.25 ml TES:H$_2$O (1:3) containing proteases inhibitors and add this to the cells. Incubate for 20 more min on ice. Spin at 3000 g for 15 min at 4° C. and transfer the supernatants into new centrifugation tubes. Resuspend the cell pellets in 6 ml TES containing 15 mM MgSO$_4$ and proteases inhibitors and incubate on ice for 15 min. Centrifuge at 3000 g for 15 min at 4° C. Transfer the supernatants into the centrifugation tubes and spin at 8000 g for 20 min at 4° C. Collect the supernatants and dialyze against PBS. The Fabs were purified by metal chelate chromatography. Incubate the dialyzed periplasmic extracts with 1 ml of TALON™ Metal Affinity Resin (Clontech) and rotate at room temperature for 2 hours. Transfer the beads into empty gravity column (Poly-Prep chromatography columns, Bio-Rad, Cat. 731-1550). Wash the beads with 5 mM imidazole in PBS and elute the Fabs with 150 mM imidazole in PBS. Dialyze against PBS using dialysis cassettes (SLIDE-A-LYSER™ Dialysis Cassettes, MWCO 10,000, Pierce, cat. no. 66380) and determine the protein concentration from the absorbance at 280 nm assuming that a 1 mg/ml solution has an absorbance of 0.86. The quality of the preparations can be analyzed by reducing and non-reducing SDS-PAGE.

Wells of an IMMULON™ 2 HB plate coated overnight with 500 ng or 50 ng of purified recombinant human Tie1-Fc target antigen per 100 microliters 0.1 M sodium bicarbonate buffer, pH 8.5. Parental E3, E3 germlined (E3g) or a negative control soluble Fab were loaded into wells at either 5 micrograms or 1 microgram per 100 microliters of PBST. Recombinant human Tie1-Fc target antigen is dissolved in an appropriate amount of acetic acid and subsequently diluted into 0.1 M sodium bicarbonate buffer, pH 9.6 at final concentrations of 500 ng and 50 ng per 100 microliters. After addition of the target antigen to the wells the microtitre plate is incubated overnight at 4° C. The plate is subsequently washed 5 times with PBST and blocked with 1% BSA in PBS at 37° C. for 2 hours. The plate is again washed plate times with wash buffer, PBST and 100 microliters per well of purified Fab at 5 or 1 micrograms per 100 microliter PBST was added followed by incubation at room temperature for 1 hour. After washing plate 7 times with PBST 100 microliters of a 1:5000 dilution of anti-sFab-HRP in PBST was added (Pierce Product #31414). After washing the wells seven times 100 microliters TMB-H$_2$O$_2$ solution was added to each well and the plate read at 630 nm in an ELISA. Both E3 and germlined E3 bound to the recombinant human Tie1-Fc target antigen by this assay.

Example 11

Production and Testing of Germlined Anti Tie1-E3-Fab for Binding to Recombinant Human Tie1 in BIAcore Recombinant purified human Tie1-Fc antigen (Stock 2.45 mg/ml) was biotinylated using the EZ-link Sulfo-NHS-SS-Biotin (Pierce, Cat. 21331). The reaction was performed for 2 hours on ice in 50 mM sodium carbonate buffer, pH 9.6, in the presence of a 5-fold molar excess of biotinylating agent and was stopped by the addition of Tris-HCl, pH 7.5 (50 mM final concentration) followed by a 1-hour incubation on ice. Samples were then dialyzed against PBS. The antigen was then diluted 1/100 fold in HBS and was then captured onto a streptavidin chip. This was coated to a density of 830RU (resonance units). All analysis was performed in HBS buffer. The parental Fab E3 and germlined E3 Fab were prepared as described above. A stock solution of 0.587 mg/ml (11740 nM) was diluted 1/587 in HBS+BSA to obtain a stock of 20 nM and the germlined Fab E3 0.025 mg/ml (500 nM) was diluted 1/25 in HBS+BSA to obtain a stock of 20 nM. Serial dilutions were made of each Fab preparation to obtain 10 nM, 5 nM, 2.5 nM, and 1.25 nM solutions. For the association phase samples were injected at 30 μl/min for 4 minutes using kinject program. This was followed by a 10 minutes dissociation phase, any remaining sample was stripped from the Tie1 Fc surface at a flow of 50 μl/min with a single injection of 5 mM NaOH+1M NaCl for 18 seconds. All samples were run and analyzed in duplicate.

Sensorgrams were analyzed using the simultaneous ka/kd fitting program with 1:1 model in the BIAEVALUATION™ software 3.1. From the analysis we can see that the germlining of the E3 antibody has had minimal effect on the binding activity of the antibody.

TABLE 2

Comparison of the binding affinity of parental and germlined E3 Fab

| E3 Fab | Tie1 Fc | $k_{on}$ (1/Ms) | $k_{off}$ (1/s) | $K_D$(1) nM |
|---|---|---|---|---|
| parental | Human | 3.00E+05 | 6.10E−04 | 2.0 |
| germlined | Human | 3.00E+05 | 1.02E−03 | 3.4 |

Example 12

Comparison of Affinity of Germlined Anti Tie1 E3-IgG to Parental Anti Tie1 E3 for Binding to Recombinant Human Tie1 Using BIAcore In order to evaluate if the binding behavior had been affected in any way by the conversion of the somatic mutations back to germline residues, the germlined antibody was produced and tested as an IgG. The germlined E3-IgG construct used to transiently transfect HEK293T cells and purified.

The germlined E3 IgG1 stock solution 0.63 mg/ml was diluted 1/50 in a buffer of pH4.5 and the parental E3 IgG1 stock solution 0.56 mg/ml (2143-001) was diluted 1/50 in a buffer of pH 4.5. The IgG were directly coated onto a CM5 chip. The surface of the chips was activated with a 7 minute pulse of 0.05M NHS/0.2M EDC and the IgG was flowed over until 780RU germlined E3-IgG and 728 non germlined E3 IgG was coated onto the surface. All flow cells were subsequently deactivated with a 7 minute pulse of 1M ethanolamine hydrochloride pH 8.5. All analysis was performed in HBS buffer. Purified recombinant human Tie1 Fc was diluted 1/28.7 in HBS to obtain a 400 nM stock solution. Serial dilutions were made to obtain 200 nM, 100 nM, 50 nM and 25 nM Tie1 Fc stocks. For analysis of the association phase samples were injected at 30 μl/min for 8.3 minutes using kinject program. This was followed by a 40 minutes dissociation phase. Any antigen remaining associated to the surface was stripped from the IgG surface at a flow of 50 μl/min with two injections of 10 mM glycine pH 1.5 for 30 seconds. All samples were run and analyzed in duplicate Sensorgrams were analyzed using the simultaneous ka/kd fitting program with 1:1 model in the BIAEVALUATION™ software 3.1. Germlining had minimal impact on the binding activity of the E3 IgG with respect to human Tie1 Fc.

TABLE 3

Comparison of the binding affinity of parental and germlined E3 IgG

| E3 IgG | Tie1 Fc | $k_{on}$ (1/Ms) | $k_{off}$ (1/s) | $K_D(1)$ nM |
|---|---|---|---|---|
| parental | Human | 6.19E+03 | 3.61E−05 | 5.83 |
| germlined | Human | 7.09E+03 | 3.67E−05 | 5.17 |

Example 13

Production and Testing of Germlined Anti Tie1-E3-Fab for Binding to Recombinant Mouse Tie1 in BIAcore Mouse Tie 1-Fc antigen (0.5 mg/ml stock) was biotinylated using established procedures and after dilution 1/100 fold in HBS this was then used for capturing to a streptavidin chip. This was coated to a resonance value of 740RU. All analysis was performed in HBS buffer. The parental Fab E3 0.587 mg/ml (11740 nM) was diluted 1/587 in HBS+BSA to obtain a stock of 20 nM and the germlined Fab E3 0.025 mg/ml (500 nM) was diluted 1/25 in HBS+BSA to obtain a stock of 20 nM. Serial dilutions were made of each Fab preparation to obtain 10 nM, 5 nM, 2.5 nM, and 1.25 nM. For the association phase samples were injected at 30 μl/min for 4 minutes using kinject program. This was followed by a 10 minutes dissociation phase, any remaining sample was stripped from the Tie1 Fc surface at a flow of 50 μl/min with a single injection of 50 mM NaOH+1 M NaCl for 18 seconds. All samples were run and analyzed in duplicate.

Sensorgrams were analyzed using the simultaneous ka/kd fitting program with 1:1 model in the BIAEVALUATION™ software 3.1. The germlining of the E3 antibody has had minimal effect on the binding activity of the antibody.

TABLE 4

Comparison of the binding affinity of parental and germlined E3 Fab

| E3 Fab | Tie1 Fc | kon (1/Ms) | koff (1/s) | KD(1) nM |
|---|---|---|---|---|
| parental | Mouse | 2.46E+05 | 9.50E−04 | 3.9 |
| germlined | Mouse | 3.40E+05 | 1.04E−03 | 3.1 |

Example 14

Comparison of Affinity of Germlined Anti Tie1 E3-IgG to Parental Anti Tie1 E3 for Binding to Recombinant Mouse Tie1 Using BIAcore In order to evaluate if the binding behavior had been affected in any way by the conversion of the somatic mutations back to germline, the germlined antibody was produced and tested as an IgG. The germlined E3 was reformatted to an IgG as described. This was then used to transiently transfect HEK293T cells using established procedures. The IgG was purified from the culture supernatant using protein A column chromatography using established procedures and the subsequent IgG was then tested for binding activity using surface plasmon resonance (BIAcore). The germlined E3 IgG1 stock solution 0,63 mg/ml (2146-002) was diluted 1/50 in a buffer of pH 4.5 and the parental E3 IgG1 stock solution 0,56 mg/ml (2143-001) was diluted 1/50 in a buffer of pH 4.5. The IgG were directly coated via onto a CM5 chip. The surface of the chips was activated with a 7 minute pulse of 0.05M NHS/0.2M EDC and the IgG was flowed over until 780RU germlined E3-IgG and 728 non germlined E3 IgG was coated onto the surface. All flow cells were subsequently deactivated with a 7 minute pulse of 1M ethanolamine hydrochloride pH8,5. All analysis was performed in HBS buffer. Purified recombinant mouse Tie1 Fc was diluted 1/6,5 in HBS to obtain a 400 nM stock solution. Serial dilutions were made to obtain 200 nM, 100 nM, 50 nM and 25 nM Tie1 Fc stocks. For analysis of the association phase samples were injected at 30 μl/min for 8,3 minutes using kinject program. This was followed by a 40 minutes dissociation phase. Any antigen remaining associated to the surface was stripped from the IgG surface at a flow of 50 μl/min with two injections of 10 mM glycine pH1,5 for 30 seconds. All samples were run and analyzed in duplicate Sensorgrams were analyzed using the simultaneous ka/kd fitting program with 1:1 model in the BIAEVALUATION™ software 3.1. The germlining process had minimal impact on the binding activity of the E3 IgG with respect to mouse Tie1-Fc.

TABLE 5

Comparison of the binding affinity of parental and germlined E3 IgG

| E3 IgG | Tie1 Fc | kon (1/Ms) | koff (1/s) | KD(1) nM |
|---|---|---|---|---|
| parental | Mouse | 6.17E+03 | 9.20E−05 | 14.9 |
| germlined | Mouse | 6.00E+03 | 8.99E−05 | 15 |

Example 15

Figure 2B:
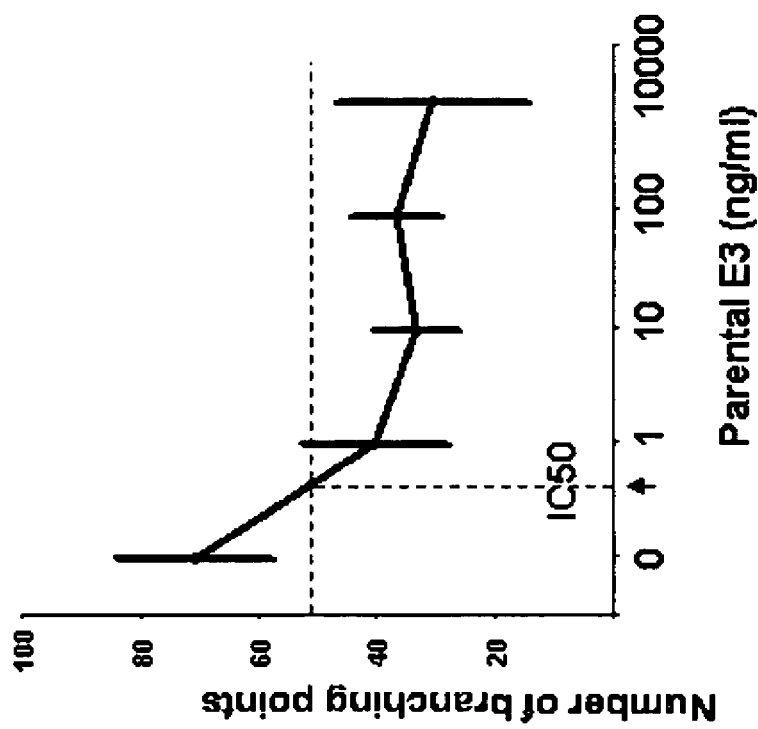
FIGS. 2A, 2B, 2C, and 2D are plots of the number of branching points versus antibody concentration comparing germlined E3 (2C and 2D) with parental E3 (2A and 2B).
Figure 2A:
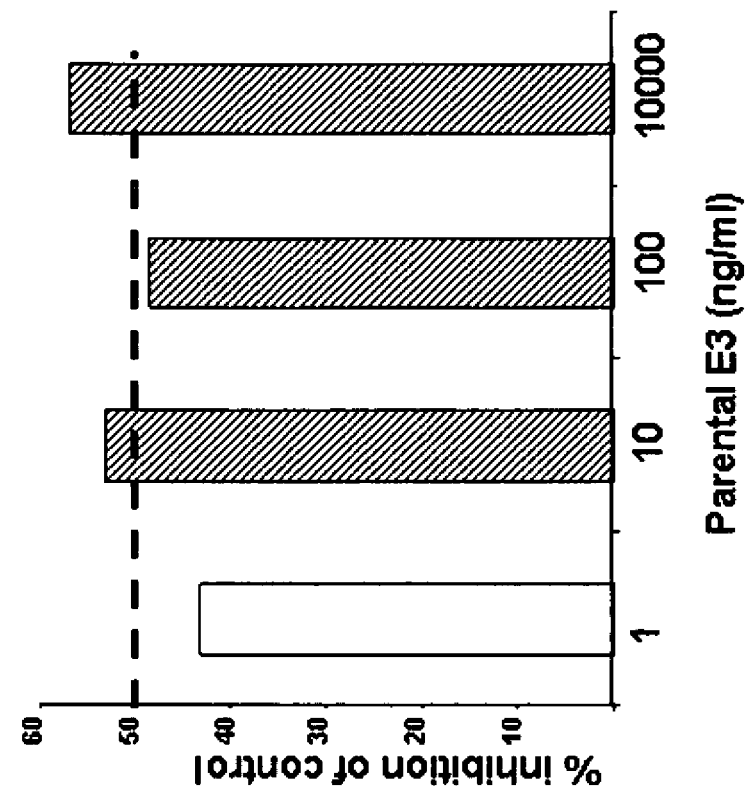
Figures 2C, 2D:
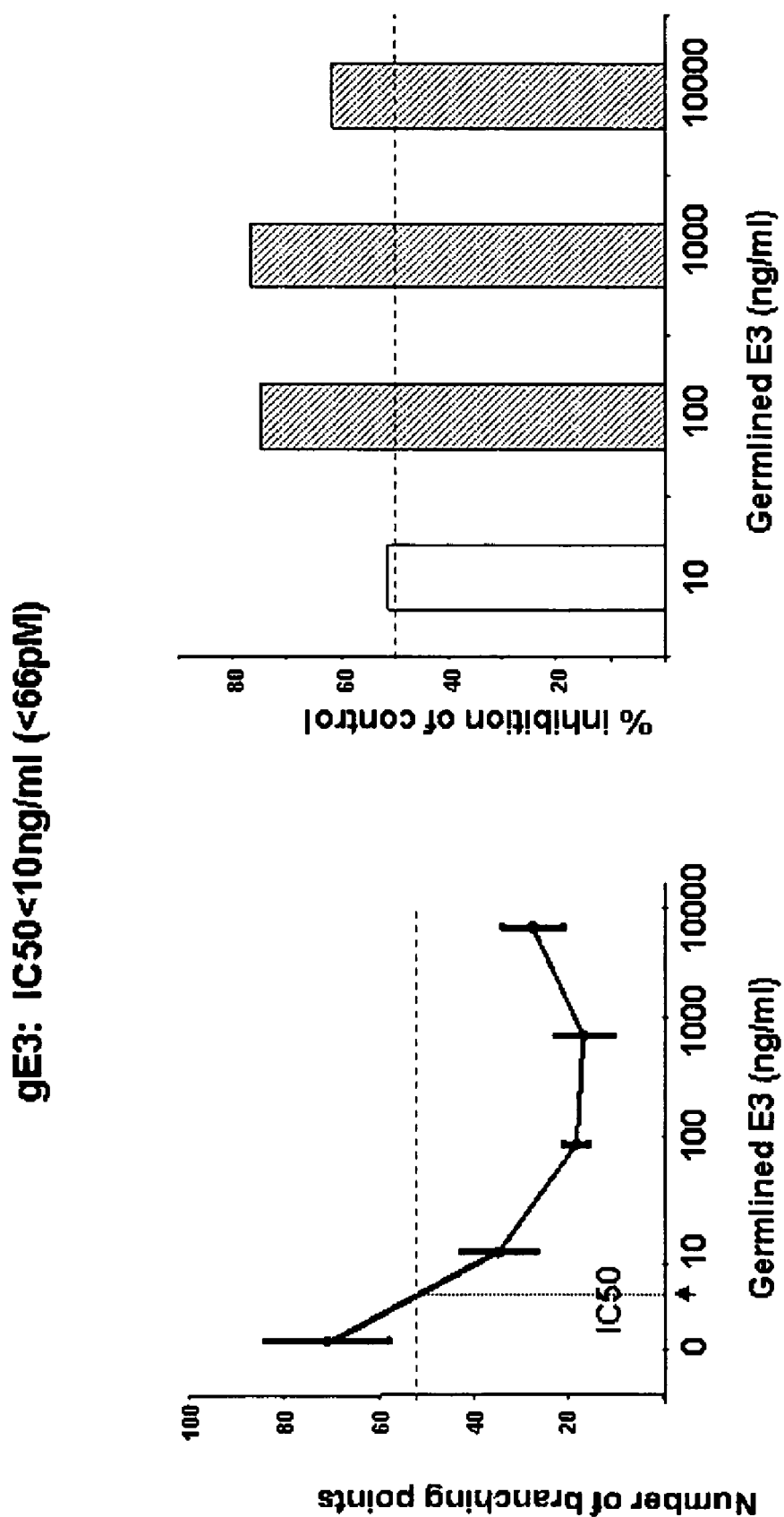

Comparison of $IC_{50}$ of Germlined Anti Tie1-E3 and Parental Anti Tie1-E3 in Tube Formation Assays using HUVEC Cells Germlined E3 (DX-2220) and its parental antibody (DX-2200) were evaluated in the tube formation assay in a collagen type-I matrix. Human Umbilical vein endothelial cells (HUVEC) (freshly isolated) were obtained by treating human umbilical cord veins with Trypsin-EDTA (1×) (Gibco/Invitrogen) for 20-25 minutes at 37° C. The cells were then cultured in a T-25 flask coated with attachment factor (AF), (Cascade Biologics) in RPMI 1640 medium supplemented with 10% FCS, 0.4% BBE, 1% 1-glutamin, 1% penicillin/streptomycin. Primary cultures were detached with warm Trypsin-EDTA and used when confluent at the second or third passage. During culturing, the cells were kept in a proliferative state by culturing them in a split ratio 1:2 at an approximate density of the monolayer of about 60-80%. HUVEC monolayers were treated with trypsin/EDTA (500 μl/dish) at 37° C. for 3 min. Trypsin activity was stopped by adding 3 volumes of complete RPMI medium. The cells were carefully scraped, separated by repeated pipetting, and finally washed with PBS. HUVECs (passage 2) were seeded in their culture medium (40×10³/50 μl/well of a 96-well plate) on a collagen gel (50 μl of collagen 11.5 mg/ml) prepared by mixing 7.5 volumes of 2 mg/ml collagen (Collagen R; Serva, Heidelberg, Germany), 1 volume of 10×MEM, 1.5 volume of NaHCO3 (15.6 mg/ml) and ~1 volume of NaOH to adjust the pH to 7.4. After 1 h 30 min., the culture medium was then discarded and the cells were covered with a new layer of collagen (1.5 mg/ml, new preparation, 50 μl/well). After polymerization of the gel, culture medium was added to each well in presence or in absence of E3 antibody (DX-2200) or germlined E3 antibody (DX-2220) (0.1 ng/ml to 100 ng/ml). The total length of the tube network on the culture surface was quantified at 40× magnification by the METAVUE™ Software (Universal Imaging Corporation). Results from triplicate wells were expressed as mean vessel area per field±SEM (relative units). Each assay was performed at least three times. The conclusions are that conversion of the three somatic mutations to germline amino acids in E3 has had little effect on the potency of E3. Both parental E3 (FIGS. 2A and 2B) and germlined E3 (FIGS. 2C and 2D) inhibit tube formation in vitro with an $IC_{50}$ less than 10 ng/ml, i.e. 66 pM.

Preliminary studies demonstrated that a monovalent Fab version of DX-2240 Fab was unable to inhibit tube formation in HUVECs. Thus, in this assay, bivalency is required to elicit an effect in a cell-based assay.

Example 16

Analysis of Germlined Anti Tie1-E3 in Tube Formation Assays With Mouse Endothelial Cells In order to assess mouse Tie1 cross-reactivity and biological activity on mouse Tie1, both E3 and germlined E3 were evaluated for their ability to inhibit tube formation in vitro using mouse endothelial cell line (LEII).

LEII lung mouse endothelial cell line (ATCC) was cultured in a T-25 flask in MEM medium with GLUTAMAX™ (Life Technologies Ltd., Paisley, Scotland) supplemented with 10% FCS, and 1% penicillin/streptomycin. During culturing, the cells were kept in a proliferative state by culturing them in a split ratio 1:5 at an approximate density of the monolayer of about 80%. LEII monolayers were treated with trypsin/EDTA (500 μl/dish) at 37° C. for 3 min. Trypsin activity was stopped by adding 3 volumes of complete MEM medium. The cells were carefully scraped, separated by repeated pipetting, and finally washed with PBS.LEII cells were seeded in their culture medium (20-40×103/50 μl/well of a 96-well plate) on a basement membrane (BIOCOAT™ Angiogenesis System; Becton Dickinson). After polymerization of the MATRIGEL™ (30 min at 37° C., 5% $CO_2$ environment) the endothelial cell suspension resuspended in complete culture medium in the presence of the desired molecules (4.105 cells/ml; 50 μl/well) was added to each well. The angiogenesis assay plate was then incubated for 16 to 18 hours at 37° C., 5% $CO_2$ atmosphere. The total length of the tube network was then quantified at 40× magnification by the METAVUE™ Software (Universal Imaging Corporation). Results from triplicate wells were expressed as mean vessel area per field±SEM (relative units). Each assay was performed at least two times. Germlined E3 is a potent inhibitor of tube formation in mouse endothelial cells.

Example 17

Immunohistochemical Analysis of Mouse Tumor Tissue Sections Using Anti Tie1-E3 IgG We determined if antibody E3 binds to mouse endothelial cells in mouse xenographs. Immunohistochemistry was performed with biotinylated E3 IgG1 (a,z allotype) antibody and control antibodies anti-CD31 (endothelial cell specific marker) and anti-PCNA (proliferating cell nuclear antigen). Formalin-fixed tumor tissues from a mouse-xenograph containing SW480 cells (ATCC) were tested for the binding pattern of the human anti-Tie1 antibody E3. 5 μm sections of paraffin embedded tissues were deparaffinized, rehydrated and pretreated with warm the citrate buffer (0.01 M sodium citrate, pH6 at 95° C.) for 45 min. The slides were cooled down in fresh citrate buffer for 20 min and rinsed with distilled water. The slides were hydrogen peroxide treated, (0.3% $H_2O_2$ in PBS), and preincubated with PBS, 5% FCS, 5% heat inactivated human serum (HS) for 1 hour. Between antibody incubations slides were washed 3 times 5 minutes in PBS. Biotinylated antibodies E3 and A2-SV were diluted to a concentration of 10 μg/ml in PBS, 10% HS and incubated for 1 hour at RT. Slides were then incubated with an avidin-HRP (Dako) for 30 minutes at room temperature. Staining was detected by AEC (Vector Laboratories, Burlingame) and $H_2O_2$. The peroxidase reaction was stopped with water and slides were counter-stained with haematoxylin. The tissues were evaluated for their binding reactivity. The staining pattern was consistent with staining of mouse endothelial cell Tie1 and also with Tie1 expressed by the E3 binds to Tie1 expressed by SW480 tumor cells in a mouse xenograft.

Example 18

E3 Activity in a MATRIGEL™ Plug Assay

The germlined variant of the E3 IgG antibody was evaluated in an in vivo assay for angiogenesis induced by bFGF in MATRIGEL™ plugs. Growth factor reduced MATRIGEL™ (BD Biosciences, catalog # 354230) was supplemented with 80 ng/ml of bFGF (R&D Systems, catalog #234-FSE). The A2-SV or an IgG4 E3 antibody (10 μg/ml) or PBS was injected subcutaneously into the abdominal area of NMRI nu/nu mice (150 μl of Matrigel/plug).

In the first assay, two mice were injected with MATRIGEL™ supplemented with bFGF and soluble VEGFR-1(10 μg/ml) as a positive control for an angiogenic inhibitor. At day 7 post-implantation mice were anesthetized and perfused through heart with 4% paraformaldehyde (PFA) in phosphate buffered saline (PBS). MATRIGEL™ plugs and a piece of liver were removed and embedded in paraffin. Sections were cut and stained with hematoxylin and eosin (H&E).

The staining revealed modification of MATRIGEL™ and formation of vessel-like structures in the PBS and A2-SV antibody treated plugs. Even though the E3 antibody and soluble VEGFR1 supplemented plugs contained single cells, there were neither modification of the matrix nor organization of the cells observed in these plugs. This results indicates that the germlined E3 antibody inhibits angiogenesis in MATRIGEL™ in vivo.

In a second assay, mice were treated as described above, and then anesthetized eight days post-implantation and injected with fluorescein-conjugated tomato (*lycopersicon esculentum*) lectin (100 μg in 200 μl of PBS; Vector, catalog #FL-1171) into the tail vein. After five min circulation the animals were perfused through the heart with 10 ml of PBS followed by 10 ml of 4% PFA in PBS. MATRIGEL™ plugs and pieces of kidney and liver were removed and frozen in OCT (Tissue-Tek). Nuclei were visualized on sections by using VECTASHIELD® mounting medium containing DAPI (Vector) and analyzed under fluorescence microscopy.

Staining of the MATRIGEL™ with fluorescein lectin revealed stain-positive material for the PBS and control antibody (A2-SV) containing plugs, but no staining could be detected in the E3 antibody containing plugs. As a control, the blood vessels of the kidney and liver from the same mice showed nice staining with the fluorescent lectin.

Results from these two experiments suggest that the anti-Tie1 antibody E3 can inhibit bFGF-induced angiogenesis in vivo.

Figure 3:
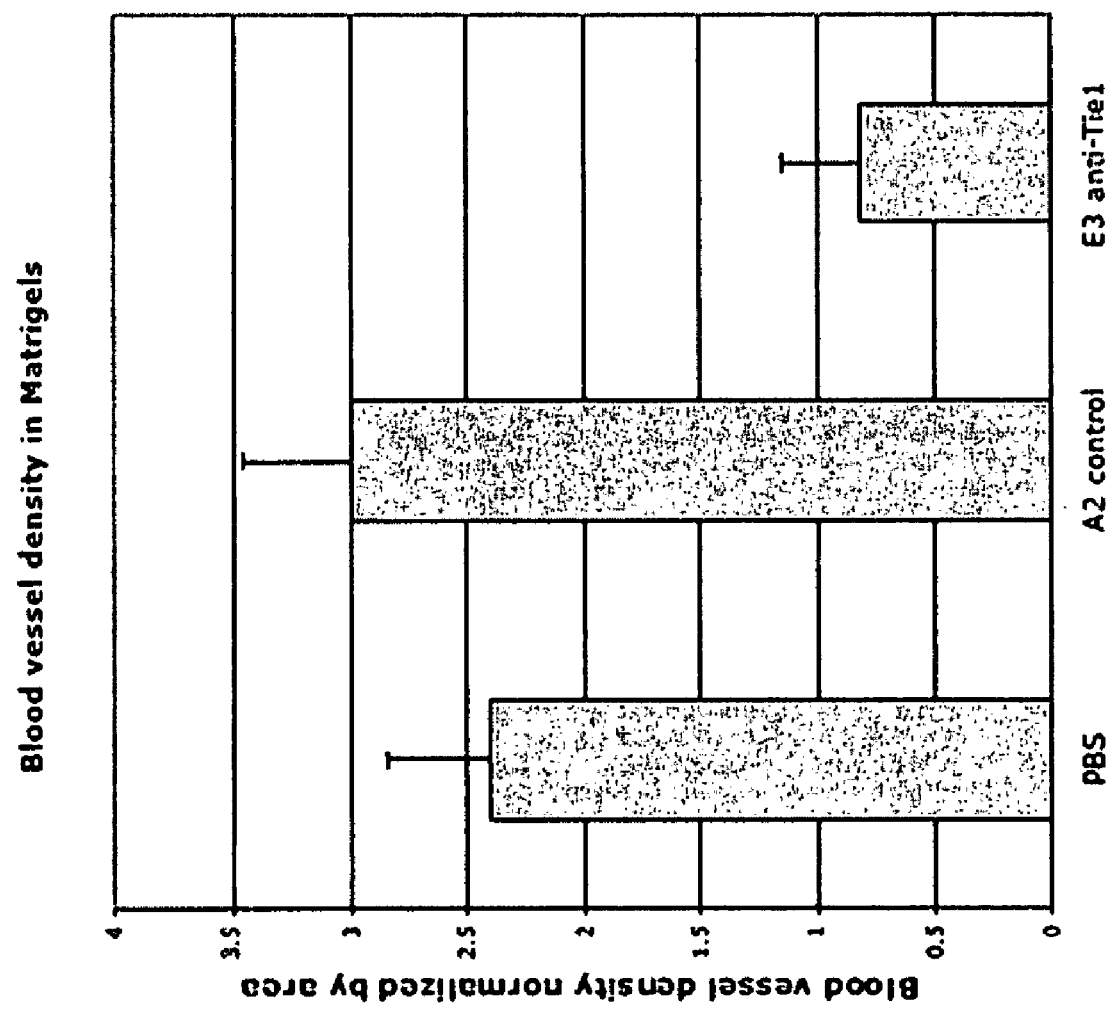
FIG. 3 depicts a graph of blood vessel density in matrigels that were stained with fluorescein-lectin from an in vivo assay using MATRIGEL™ and evaluating the germlined E3 antibody.

To assess further the potential anti-angiogenic activity of the E3 antibody, a third assay examining the effect of DX-2210 (E3 antibody with germlined light chain) on bFGF-induced endothelial cell tube formation in MATRIGEL™ plugs was performed. Growth factor reduced MATRIGEL™ supplemented with HUVECs, bFGF, and DX-2210, A2-SV (negative control IgG), or PBS were injected subcutaneously into the abdominal area of Balb/c nu/nu mice (150 μl MATRIGEL™/plug). At day 8 post-implantation, mice were anesthetized and injected with fluorescein-conjugated tomato (*Lycopercicon esculentum*) lectin into the tail vein. After a five minute circulation period, the MATRIGEL™ plugs and liver and kidneys were removed and frozen in OCT media. In order to quantitate the amount of blood vessels in the MATRIGEL™ plugs, sections were cut and either stained for endothelial cell content using an anti-CD-31 antibody or analyzed under fluorescence microscopy to assess the amount of functional blood vessels (tomato lectin staining) (data not shown). In addition, the amount of blood vessels per unit area was quantitated. These results demonstrated that DX-2210 inhibits bFGF-induced angiogenesis by 70% in the MATRIGEL™ assay (FIG. 3).

Example 19

Evaluating Effects of Ligands on Complex Formation

A candidate protein (for example, E3 or E3b antibody) that binds a complex member, such as Tie1, Tie2, or an angiopoietin is tested for its ability to antagonize formation of a heteromeric complex that includes Tie1, Tie2, and Ang, by inhibiting its formation or disrupting the heteromeric complex once it forms.

To test the ability of a candidate protein to disrupt complex formation, cells expressing Tie1 and Tie2 are treated with Ang for a period of time sufficient to allow binding of Ang to Tie1 and/or Tie2. The cells are contacted with the candidate protein for a period of time sufficient to allow disruption of the complex. The cells are treated with a membrane non-permeable cross-linker, such as DTSSP, to chemically cross-link the proteins. Cell lysates are prepared and subjected to immunoprecipitation with an antibody specific to a complex member. The immunoprecipitated proteins are separated by SDS-PAGE electrophoresis and immunoblotted with antibodies specific to the complex members. A positive control immunoprecipitation-immunoblot is also performed in which cells expressing Tie1 and Tie2 are treated with Ang but not with the candidate protein or are treated with a nonspecific protein. If treatment with the candidate protein decreases the amount of a complex member—that is not bound by the immunoprecipitating antibody—associated with the immunoprecipitated member as compared to the positive control, the candidate protein is an antagonist of complex formation.

To determine if a candidate protein inhibits complex formation, a similar experiment is performed, except that the cells expressing Tie1 and Tie2 are treated with the candidate protein prior to treatment of the cells with Ang. The cells are incubated for a period of time sufficient to allow complex formation in the absence of candidate protein. As described above, a positive control in which the cells are not treated with a candidate protein or are treated with a nonspecific protein is performed. The treated cells are then lysed and immunoprecipitations and immunoblots are performed as described above.

Candidate proteins that antagonize complex formation, by inhibiting complex formation or by disrupting complexes, are then tested for their effects on angiogenesis in an assay described herein.

Example 20

Tie2 Amino Acid Sequence

An exemplary Tie2 amino acid sequence is as follows:

```
MDSLASLVLC GVSLLLSGTV EGAMDLILIN SLPLVSDAET SLTCIASGWR    50
PHEPITIGRD FEALMNQHQD PLEVTQDVTR EWAKKVVWKR EKASKINGAY   100
FCEGRVRGEA IRIRTMKMRQ QASFLPATLT MTVDKGDNVN ISFKKVLIKE   150
EDAVIYKNGS FIHSVPRHEV PDILEVHLPH AQPQDAGVYS ARYIGGNLFT   200
SAFTRLIVRR CEAQKWGPEC NHLCTACMNN GVCHEDTGEC ICPPGFMGRT   250
CEKACELHTF GRTCKERCSG QEGCKSYVFC LPDPYGCSCA TGWKGLQCNE   300
ACHPGFYGPD CKLRCSCNNG EMCDRFQGCL CSPGWQGLQC EREGIPRMTP   350
KIVDLPDHIE VNSGKFNPIC KASGWPLPTN EEMTLVKPDG TVLHPKDFNH   400
TDHFSVAIFT IHRILPPDSG VWVCSVNTVA GMVEKPFNIS VKVLPKPLNA   450
PNVIDTGHNF AVINISSEPY FGDGPIKSKK LLYKPVNHYE AWQHIQVTNE   500
IVTLNYLEPR TEYELCVQLV RRGEGGEGHP GPVRRFTTAS IGLPPPRGLN   550
LLPKSQTTLN LTWQPIFPSS EDDFYVEVER RSVQKSDQQN IKVPGNLTSV   600
LLNNLHPREQ YVVRARVNTK AQGEWSEDLT AWTLSDILPP QPENIKISNI   650
THSSAVISWT ILDGYSISSI TIRYKVQGKN EDQHVDVKIK NATIIQYQLK   700
GLEPETAYQV DIFAENNIGS SNPAFSHELV TLPESQAPAD LGGGKMLLIA   750
```

```
ILGSAGMTCL  TVLLAFLIIL  QLKRANVQRR  MAQAFQNVRE  EPAVQFNSGT   800

LALNRKVKNN  PDPTIYPVLD  WNDIKFQDVI  GEGNFGQVLK  ARIKKDGLRM   850

DAAIKRMKEY  ASKDDHRDFA  GELEVLCKLG  HHPNIINLLG  ACEHRGYLYL   900

AIEYAPHGNL  LDFLRKSRVL  ETDPAFAIAN  STASTLSSQQ  LLHFAADVAR   950

GMDYLSQKQF  IHRDLAARNI  LVGENYVAKI  ADFGLSRGQE  VYVKKTMGRL  1000

PVRWMAIESL  NYSVYTTNSD  VWSYGVLLWE  IVSLGGTPYC  GMTCAELYEK  1050

LPQGYRLEKP  LNCDDEVYDL  MRQCWREKPY  ERPSFAQILV  SLNRMLEERK  1100

TYVNTTLYEK  FTYAGIDCSA  EEAA                                1124

(SEQ ID NO: 162) SWISS PROT ACCESSION NUMBER: Q02763
```

Example 21

Ang1 Amino Acid Sequence

An exemplary Ang1 amino acid sequence is as follows:

```
  1 MTVFLSFAFL  AAILTHIGCS  NQRRSPENSG  RRYNRIQHGQ  CAYTFILPEH  DGNCRESTTD

61 QYNTNALQRD  APHVEPDFSS  QKLQHLEHVM  ENYTQWLQKL  ENYIVENMKS  EMAQIQQNAV

121 QNHTATMLEI  GTSLLSQTAE  QTRKLTDVET  QVLNQTSRLE  IQLLENSLST  YKLEKQLLQQ

181 TNEILKIHEK  NSLLEHKILE  MEGKHKEELD  TLKEEKENLQ  GLVTRQTYII  QELEKQLNRA

241 TTNNSVLQKQ  QLELMDTVHN  LVNLCTKEVL  LKGGKREEEK  PFRDCADVYQ  AGFNKSGIYT

301 IYINNMPEPK  KVFCNMDVNG  GGWTVIQHRE  DGSLDFQRGW  KEYKMGFGNP  SGEYWLGNEF

361 IFAITSQRQY  MLRIELMDWE  GNRAYSQYDR  FHIGNEKQNY  RLYLKGHTGT  AGKQSSLILH

421 GADFSTKDAD  NDNCMCKCAL  MLTGGWWFDA  CGPSNLNGMF  YTAGQNHGKL  NGIKWHYFKG

481 PSYSLRSTTM  MIRPLDF (SEQ ID NO: 163) NCBI ACCESSION NUMBER: AAM92271; gi: 22203641
```

Example 22

Conversion of a Mutation Positioned in the Framework 3 Region of Anti-Tie1 E3 Heavy Chain to Germline Residue In order to limit the risk of potential immunogenicity of the E3 antibody after administration to patients, all non-germline mutations in framework regions were corrected back to germline amino acid residues. The anti-Tie1 E03 antibody was isolated from Dyax Fab 200 library. In this library, the HC framework regions are unique and correspond to the DP47 germline segment (V3-23). Since the construction of the synthetic HC-CDR1-CDR2 sublibrary was made through the assembling of overlapping oligonucleotides, followed by some PCR cycles, mutations may have been introduced by one of those 2 steps. Therefore, an analysis was performed which aligned the HC of E03 antibody with the DP47 germline gene sequence. One non-germline mutation positioned in framework region number 3 was identified where a methionine residue has been replaced by a valine residue.

A strategy was designed to repair this mutation. The introduction of the germlined residue was facilitated by the presence of internal restriction sites in the framework flanking regions of the CDRs. Indeed, the design of the HC-CDR1-CDR2 sublibrary, present in FAB 310 library, was made in such a way that the shuffling of every CDR is allowed by the presence of unique restriction sites in the framework flanking regions. Since the valine residue to be corrected is located in FR3 region, 3' near the XbaI site, a primer was designed containing both the XbaI sequence and the corrected methionine germline residue. The changes were introduced by PCR using the Top XbaI-M forward primer combined with a 3' reverse primer (CJ-lift Nhe REV) annealing in the CH1 region. A PCR fragment of ~180 bp was then generated. The germlining PCR primers were:

```
Top XbaI -M primer:
5' TTCACTATCTCTAGAGACAACTCTAAGAATACTCTCTACTTGCAGaTGAAC 3'  (SEQ ID NO: 717)

F    T    I    S    R    D    N    S    K    N    T    L    Y    L    Q    M    N    (SEQ ID NO: 718)
```

-continued

CJ-1ift Nhe REV:
5' GGAGGGTGCTAGCGGGAAGACCG 3'

(SEQ ID NO: 719)

Example 23

Cloning of Germlined Heavy Chain Tie1 E3

In order to determine if the germlined residue introduced into E3 heavy chain had affected the biological activity of the antibody, a soluble Fab expression vector containing the germlined E3 antibody (termed "E3b" or DX-2220) was constructed. The PCR fragment from Example 22 was digested overnight with 50 U/μg XbaI restriction enzyme, followed by a 5 hours digestion with 25 U/μg BstEII. The cleaved PCR product was then purified on a 1% TAE-agarose preparative gel. Ligation into the similarly-digested phagemid expression vector (PMID1) containing the Tie1 E3 germlined light chain sequence was performed for three hours at room temperature. Five nanograms of the newly-ligated material were electroporated into TG1 bacterial cells. Verification of the correction of the mutation was performed by sequence determination of the heavy chain of 20 randomly picked isolates. The resulting coding construct contained sequences that encode a germlined HC and a germlined LC sequence in a Fab format (termed Fab E3b).

Example 24

Production and Purification of E3b (DX-2220)

The E3b Fab antibody was reformatted to a human IgG1. This construct was then used to transiently transfect HEK293T cells. Plasmid preparations for transient cell transfections were obtained using the Qiagen filter Plasmid Maxi kit (Qiagen, cat. no. 12263). HEK293T cells (GenHunter Corp., cat. no. Q401) were seeded 24 hours before transfection; 220×10$^6$ cells were plated per CELLSTACK® culture vessel (CellSTACK®-10 Chamber, Corning, cat. no. 3271). Transfections were carried out using the GeneJuice® reagent (VWR, cat. no. novg70967-3) following the manufacturer's instructions. 650 micrograms of plasmid DNA was used per CELLSTACK®. Cells were cultured in DMEM (Invitrogen, cat. no. 31966021) supplemented with 10% "ultra-low IgG" fetal calf serum (Invitrogen, cat. no. 16250078), at 37° C., 5% $CO_2$, in a water saturated atmosphere. Conditioned media were harvested 72, 144 and 216 hours after transfection, pooled and sterile filtered.

Cell culture supernatants were loaded on a 25-ml rProteinA FF column (GE Healthcare, cat. no. 17-1279-02) equilibrated against PBS containing 0.5 M NaCl. The column was washed with PBS containing 0.5 M NaCl, then with 0.1 M sodium acetate pH 5.0 to remove bovine IgGs and the antibody was eluted with 12.5 mM citric acid. Fractions (5 ml) containing the antibody were neutralized by addition of 150 μl of 1 M Tris-HCl, pH 9.0.

The E3b antibody was further purified by cation exchange. The antibody was dialyzed against 50 mM sodium citrate, pH 5.0, and loaded on a HiLoad 26/10 SP Sepharose HP column (GE Healthcare, cat. no. 17-1138-01) equilibrated in the same buffer. The antibody was eluted with 50 mM sodium citrate, pH 5.0, containing 1 M NaCl (linear gradient on 10 column volumes). Fractions containing the antibody were pooled and dialyzed against PBS. Antibody concentration was calculated from the absorbance at 280 nm, assuming that a protein concentration of 1 mg/ml has an absorbance of 1.36.

Example 25

Testing of E3b-IgG1 Binding to TIE-1/Fc in BIAcore

The germlined E3b IgG1 stock solution (0.56 mg/ml) and the parental E3 IgG1 stock solution (0.41 mg/ml) were diluted 50-fold in 10 mM sodium acetate, pH 4.5. The IgGs were directly coated on a CM5 chip. The surface of the chip was activated with a 7-minute pulse of 0.05 M NHS/0.2 M EDC and the IgG was run over the chip until 823 RU of germlined E3b and 788 RU of parental E3 were coated on the surface. All flow cells were subsequently deactivated with a 7-minute pulse of 1 M ethanolamine hydrochloride, pH 8.5. All further experiments were performed in HBS buffer.

Purified recombinant human Tie1/Fc was diluted in HBS to final concentrations of 200, 100, 50, 25 and 12.5 nM. Samples were injected at 30 μl/min for 8.3 minutes using the kinject program. This was followed by a 50-minute dissociation phase. Any remaining antigen was stripped from the surface with two 30-sec injections of 10 mM glycine, pH 1.5.

The sensorgrams obtained with this approach are shown below. Visual analysis shows that the dissociation ($k_{off}$) is extremely slow (only a very small fraction of Tie1/Fc dissociated despite the long dissociation time), which suggests a very tight interaction. Interestingly, the dissociation rates for the IgGs as measured here are much slower that those of the corresponding Fabs (see Example 29 below), indicating that there is a significant increase in the affinity when going from the monovalent Fab to the bivalent IgG (avidity).

Example 26

Testing of E3b-Fab Binding to Tie1/Fc in BIAcore

To evaluate if the binding behaviour had been affected in any way by the conversion of the somatic mutations back to germline residues, the parental and the germlined E3b antibodies were produced and tested in Biacore as Fab fragments. Here, by contrast to what was done for the IgGs (see Example 28), and in order to measure a monovalent interaction, the Fabs were run over the antigen directly coated onto the surface.

Recombinant human Tie1/Fc was coated on a CM5 chip. The surface of the chip was first activated with a 7-minute pulse of 0.05 M NHS/0.2 M EDC, then Tie1/Fc (2 μg/ml in 10 mM sodium acetate, pH 4.0) was run over the chip surface until 750 RUs were coated on the surface. All flow cells were subsequently deactivated with a 7-minute pulse of 1 M ethanolamine hydrochloride, pH 8.5. All further experiments were performed in HBS buffer.

The parental and the germlined E3b Fabs were prepared. A series of dilution (50, 25, 12.5, 6.25 and 3.125 nM) was prepared in HBS buffer. Samples were injected at 30 μl/min for 5.3 minutes using the KINJECT™ program. This was followed by a 10-minute dissociation phase, and the remaining Fab was stripped from the surface with a single 18-sec injection of 50 mM NaOH/1 M NaCl.

Sensorgrams were analyzed using the simultaneous ka/kd fitting program from the BIAEVALUATION™ software 3.1 assuming a 1:1 model. This analysis proved that the germlining of the E3 antibody has little or no effect on the affinity against Tie1/Fc:

| E3 Fab | Tie1 Fc | kon (1/Ms) | koff (1/s) | KD (nM) |
|---|---|---|---|---|
| Parental | Human | 8.81e4 | 1.05e−03 | 12 |
| germlined (E3b) | Human | 1.36e5 | 1.01e−03 | 7 |

Example 27

Testing of E3-IgG for Biological Activity in Tube Formation Assay

Figure 4:
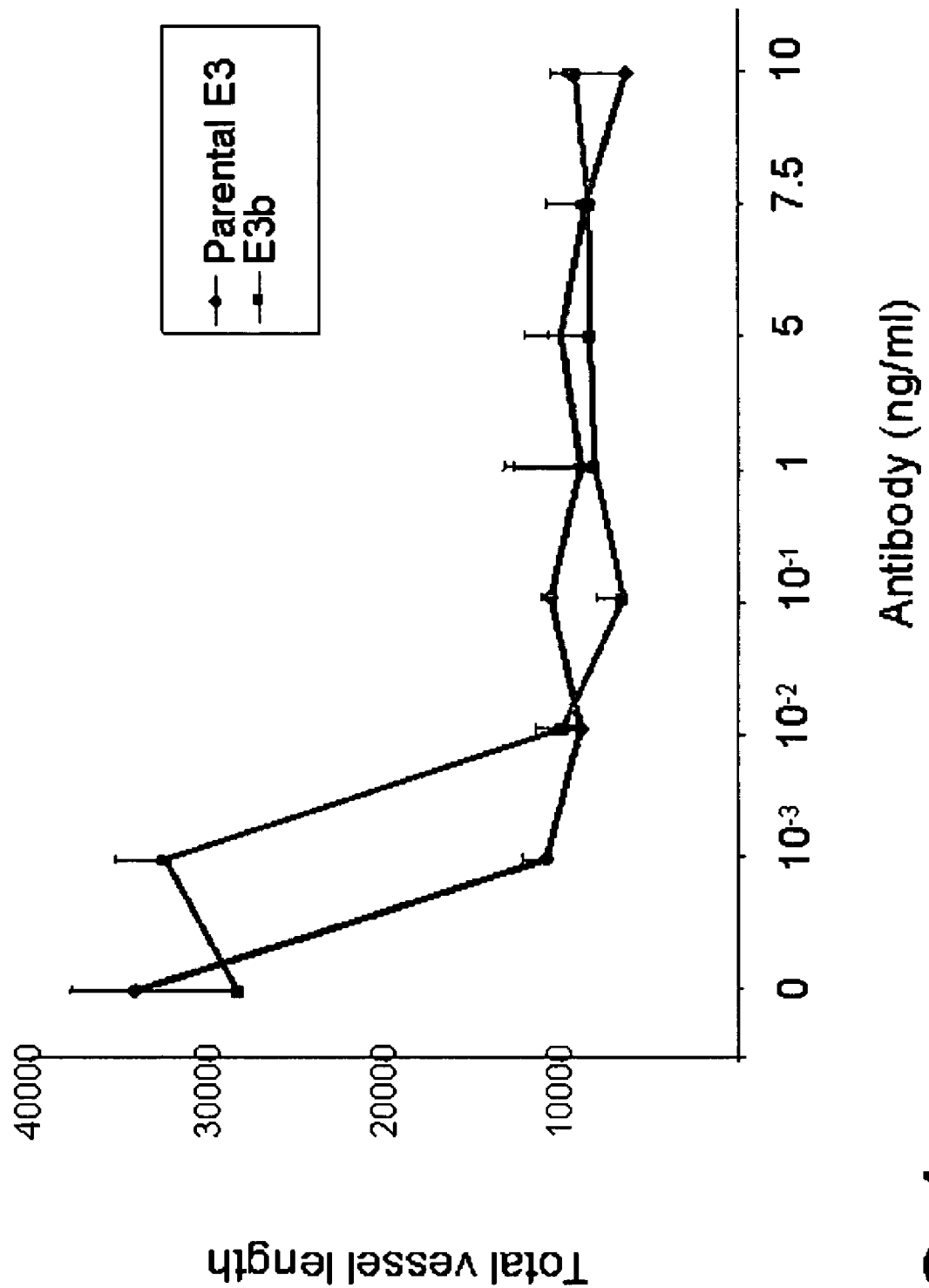
FIG. 4 depicts results of tube formation in HUVECs using the parental E3 and E3b (germlined) proteins.

The purpose of this study was to determine if the correction of HC mutation back to germline in the parental E3 has any effect on the biological activity. Human umbilical vein endothelial cells (HUVEC) (freshly isolated) were obtained by treating human umbilical cord veins with Trypsin-EDTA (1×) (Gibco/Invitrogen) for 20-25 minutes at 37° C. The cells were then cultured in a T-25 flask coated with attachment factor (AF), (Cascade Biologics) in RPMI 1640 medium supplemented with 10% FCS, 0.4% BBE, 1% l-glutamin, 1% penicillin/streptomycin. Primary cultures were detached with warm Trypsin-EDTA and used when confluent at the second or third passage. During culturing, the cells were kept in a proliferative state by culturing them in a split ratio 1:2 at an approximate density of the monolayer of about 60-80%. HUVEC monolayers were treated with trypsin/EDTA (500 µl/dish) at 37° C. for 3 min. Trypsin activity was stopped by adding 3 volumes of complete RPMI medium. The cells were carefully scraped, separated by repeated pipetting, and finally washed with PBS. HUVECs (passage 3) were seeded in their culture medium ($40×10^3$/50 Ill/well of a 96-well plate) on a collagen gel (50 µl of collagen I 1.5 mg/ml) prepared by mixing 7.5 volumes of 2 mg/ml collagen (Collagen R; Serva, Heidelberg, Germany), 1 volume of 10×MEM, 1.5 volume of $NaHCO_3$(15.6 mg/ml) and ~1 volume of NaOH to adjust the pH to 7.4. After 1 h 30 min, the culture medium was then discarded and the cells were covered with a new layer of collagen (1.5 mg/ml, new preparation, 50 µl/well). After polymerization of the gel, culture medium was added to each well in presence or in absence of E3b-IgG1 or parental E3 antibody (1 pg/ml to 10 ng/ml). Endothelial tube formation was assessed with an inverted photomicroscope. Microphotographs of the centre of each well at low power (×40) were taken with a Nikon camera with the aid of imaging-capture software. Tube formation in the microphotographs was quantitatively analysed (total tube length) with METAVUE® software (data not shown). Tube formation by untreated HUVECs in full endothelial cell growth medium was used as control. Results from triplicate wells were expressed as mean vessel area per field±SEM (relative units) (FIG. 4). The conclusions are that E3b-IgG1 inhibits tube formation. Correction of HC mutation had no significant effect on biological activity.

Example 28

Exemplary Tie1 Binding Sequences

The following are exemplary sequences of immunoglobulin light chain and heavy chain variable domains:

```
1. 806C-M0044-A06
   L-Variable (AA):
   QSELTQPPSASGTPGQRVTISCSGSSSSIGLNPVNWYQQLPGTAPKVVIHSNDQRPSGV      (SEQ ID NO: 164)

PDRFSGSKSGTSASLAISGLQSEDEADYYCAAWDDSLNGPAFGGGTKLTVL

L-Variable (DNA):
   CAGAGCGAATTGACTCAGCCACCCTCAGCGTCTGGGACCCCCGGGCAGAGGGTCACCAT     (SEQ ID NO: 165)

CTCTTGTTCTGGAAGCAGCTCCAGCATCGGACTTAATCCTGTAAACTGGTACCAGCAGCTCCCAG

GAACGGCCCCCAAAGTAGTCATCCATAGTAATGATCAGCGGCCCTCAGGGGTCCCTGACCGATTC

TCTGGCTCCAAGTCTGGCACCTCAGCCTCCCTGGCCATCAGTGGACTCCAGTCTGAGGATGAGGC

TGATTATTACTGTGCAGCATGGGATGACAGCCTGAATGGTCCGGCATTCGGCGGAGGGACCAAGC

TGACCGTCCTAG

H-Variable (AA):
EVQLLESGGGLVQPGGSLRLSCAASGFTFSSYVMMWVRQAPGKGLEWVSRIYPSGGITQYADSVK   (SEQ ID NO: 166)

GRFTISRDNSKNTLYLQMNSLRAEDTAVYYCARDVYRAFDIWGQGTMVTVSS

H-Variable (DNA):
   GAAGTTCAATTGTTAGAGTCTGGTGGCGGTCTTGTTCAGCCTGGTGGTTCTTTACGTCTTTCTTG   (SEQ ID NO: 167)

CGCTGCTTCCGGATTCACTTTCTCTTCTTACGTTATGATGTGGGTTCGCCAAGCTCCTGGTAAAG

GTTTGGAGTGGGTTTCTCGTATCTATCCTTCTGGTGGCATTACTCAGTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCAAGAGATGTCTACAGGGCTTTTGATATCTGGGGCC

AAGGGACAATGGTCACCGTCTCAAGC
```

-continued 2. 806C-M0044-A11
L-Variable (AA):
QDIQMTQSPGTLSLSPGERATLSCRASQSVSSSYLAWYQQKPGQAPRLLIYGASSRATGIPDRFS (SEQ ID NO: 168)

GSGSGTDFTLTISRLEPEDFAVYYCQQYGSSPPGGTFGQGTKVEIK

L-Variable (DNA):
CAAGACATCCAGATGACCCAGTCTCCAGGCACCCTGTCTTTGTCTCCAGGGGAAAGAGCCACCCT (SEQ ID NO: 169)

CTCCTGCAGGGCCAGTCAGAGTGTTAGCAGCAGCTACTTAGCCTGGTACCAGCAGAAACCTGGCC

AGGCTCCCAGGCTCCTCATCTATGGTGCATCCAGCAGGGCCACTGGCATCCCAGACAGGTTCAGT

GGCAGTGGGTCTGGGACAGACTTCACTCTCACCATCAGCAGACTGGAGCCTGAAGATTTTGCAGT

GTATTACTGTCAGCAGTATGGTAGCTCACCTCCGGGGGGAACGTTCGGCCAAGGGACCAAGGTGG

AAATCAAA

H-Variable (AA):
EVQLLESGGGLVQPGGSLRLSCAASGFTFSSYKMHWVRQAPGKGLEWVSSIYPSGGYTYYADSVK (SEQ ID NO: 170)

GRFTISRDNSKNTLYLQMNSLRAEDTAVYYCARDSHHFHFWGDYYFLEYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 171)

CGCTGCTTCCGGATTCACTTTCTCTTCTTACAAGATGCATTGGGTTCGCCAAGCTCCTGGTAAAG

GTTTGGAGTGGGTTTCTTCTATCTATCCTTCTGGTGGCTATACTTATTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTATATTACTGTGCGAGAGATAGCCATCATTTCCATTTTTGGGGTGACT

ATTATTTTCTAGAATACTGGGGCCAGGGAACCCTGGTCACCGTCTCAAGC 3. 806C-M0044-B04
L-Variable (AA):
QDIQMTQSPSSLSASVGDRVTITCRASQSISSYLNWYQQKPGKAPKLLIYAASSLQSGVPSRFSG (SEQ ID NO: 172)

SGSGTDFTLTISSLQPEDFATYYCQQSYSTPPTFGGGTKVEIK

L-Variable (DNA):
CAAGACATCCAGATGACCCAGTCTCCATCCTCCCTGTCTGCATCTGTAGGAGACAGAGTCACCAT (SEQ ID NO: 173)

CACTTGCCGGGCAAGTCAGAGCATTAGCAGCTATTTAAATTGGTATCAGCAGAAACCAGGGAAAG

CCCCTAAGCTCCTGATCTATGCTGCATCCAGTTTGCAAAGTGGGGTCCCATCAAGGTTCAGTGGC

AGTGGATCTGGGACAGATTTCACTCTCACCATCAGCAGTCTGCAACCTGAAGATTTTGCAACTTA

CTACTGTCAACAGAGTTACAGTACCCCTCCCACTTTCGGCGGAGGGACCAAGGTGGAGATCAAA

H-Variable (AA):
EVQLLESGGGLVQPGGSLRLSCAASGFTFSQYLMFWVRQAPGKGLEWVSYIYPSGGWTMYADSVK (SEQ ID NO: 174)

GRFTISRDNSKNTLYLQMNSLRAEDTAVYYCARQNYYDSSGYYYRGFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 175)

CGCTGCTTCCGGATTCACTTTCTCTCAGTACCTTATGTTTTGGGTTCGCCAAGCTCCTGGTAAAG

GTTTGGAGTGGGTTTCTTATATCTATCCTTCTGGTGGCTGGACTATGTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCGAGGCAAAATTACTATGATAGTAGTGGTTATTACT

ATCGTGGCTTTGACTACTGGGGCCAGGGAACCCTGGTCACCGTCTCAAGC 4. 806C-M0044-B05
L-Variable (AA):
DIHMTQSPATLSLSPGERATLSCRASQSVSSYLAWYQQKPGQAPRLLIYDASNRATGIPARFSGS (SEQ ID NO: 176)

GSGTDFTLTISSLEPEDFAVYYCQQRSNWPPGITFGGGTKVEIK

L-Variable (DNA):
GACATCCATATGACCCAGTCTCCAGCCACCCTGTCTTTGTCTCCAGGGGAAAGAGCCACCCTCTC (SEQ ID NO: 177)

CTGCAGGGCCAGTCAGAGTGTTAGCAGCTACTTAGCCTGGTACCAACAGAAACCTGGCCAGGCTC

CCAGGCTCCTCATCTATGATGCATCCAACAGGGCCACTGGCATCCCAGCCAGGTTCAGTGGCAGT

GGGTCTGGGACAGACTTCACTCTCACCATCAGCAGCCTAGAGCCTGAAGATTTTGCAGTTTATTA

CTGTCAGCAGCGTAGCAACTGGCCTCCGGGGATCACTTTCGGCGGAGGGACCAAGGTGGAGATCA

AA

H-Variable (AA):
EVQLLESGGGLVQPGGSLRLSCAASGFTFSSYKMGWVRQAPGKGLEWVSSIYPSGGWTHYADSVK (SEQ ID NO: 178)

GRFTISRDNSKNTLYLQMNSLRAEDTAVYYCARVLLHYFDYWGQGTLVTVSS

H-Variable (DNA):
GAAGTTCAATTGTTAGAGTCTGGTGGCGGTCTTGTTCAGCCTGGTGGTTCTTTACGTCT (SEQ ID NO: 179)

TTCTTGCGCTGCTTCCGGATTCACTTTCTCTTCTTACAAGATGGGTTGGGTTCGCCAAGCTCCTG

GTAAAGGTTTGGAGTGGGTTTCTTCTATCTATCCTTCTGGTGGCTGGACTCATTATGCTGACTCC

GTTAAAGGTCGCTTCACTATCTCTAGAGACAACTCTAAGAATACTCTCTACTTGCAGATGAACAG

CTTAAGGGCTGAGGACACTGCAGTCTACTATTGTGCAAGAGTACTACTACACTACTTTGACTACT

GGGGCCAGGGAACCCTGGTCACCGTCTCAAGC 5. 806C-M0044-B08
    L-Variable (AA):
QDIQMTQSPSFLSASVGDRVTISCRASQYISIYLNWYQQRPGEAPKLLINAASSLQSGDPSRFSG (SEQ ID NO: 180)

SGSGTDFTLTINSLQPDDFATYYCQQYKSYPLTFGEGTKVEIK

L-Variable (DNA):
CAAGACATCCAGATGACCCAGTCTCCATCCTTCCTGTCCGCATCTGTAGGAGACAGAGTCACCAT (SEQ ID NO: 181)

CTCTTGCCGGGCAAGTCAGTACATCAGCATATATTTGAATTGGTATCAGCAGAGACCAGGGGAAG

CCCCTAAACTCCTGATCAATGCTGCATCCAGTTTGCAAAGTGGGGACCCATCAAGGTTCAGTGGC

AGTGGATCTGGGACAGATTTCACTCTCACCATCAACAGCCTGCAGCCTGATGATTTTGCAACTTA

TTACTGCCAACAGTATAAGAGTTACCCCCTCACTTTCGGCGAGGGGACCAAGGTGGAGATCAAA

H-Variable (AA):
EVQLLESGGGLVQPGGSLRLSCAASGFTFSAYGMGWVRQAPGKGLEWVSVISPSGGQTSYADSVK (SEQ ID NO: 182)

GRFTISRDNSKNTLYLQMNSLRAEDTALYYCAGGDRYGPLHYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 183)

CGCTGCTTCCGGATTCACTTTCTCTGCTTACGGTATGGGTTGGGTTCGCCAAGCTCCTGGTAAAG

GTTTGGAGTGGGTTTCTGTTATCTCTCCTTCTGGTGGCCAGACTTCTTATGCTGACTCCGTTAAA

GGTCGCTTCACTATCTCTAGAGACAACTCTAAGAATACTCTCTACTTGCAGATGAACAGCTTAAG

GGCTGAGGACACCGCCTTGTATTACTGTGCGGGAGGGGACAGGTATGGACCCTTGCACTACTGGG

GCCAGGGAACCCTGGTCACCGTCTCAAGC 6. 806C-M0044-B09
    L-Variable (AA):
QDIQMTQSPSSLSASVGDRVTITCQASQDISNYLNWYQQKPGKAPKLLIYHASNLETGVPSRFSG (SEQ ID NO: 184)

SGSGTDFTLTISSLQPEDFATYYCLQYKSYPRLFGQGTKVEVK

L-Variable (DNA):
CAAGACATCCAGATGACCCAGTCTCCATCCTCCCTGTCTGCATCTGTAGGAGACAGAGTCACCAT (SEQ ID NO: 185)

CACTTGCCAGGCGAGTCAGGACATTAGCAACTATTTAAATTGGTATCAGCAGAAACCAGGGAAAG

CCCCTAAGCTCCTGATCTACCATGCATCCAATTTGGAAACAGGGGTCCCATCAAGGTTCAGTGGA

-continued

AGTGGATCTGGGACAGATTTCACTCTCACCATCAGCAGTCTGCAACCTGAAGATTTTGCAACTTA

TTACTGTCTTCAGTATAAAAGTTACCCTCGATTGTTCGGCCAAGGGACCAAGGTGGAAGTCAAA

```
    H-Variable (AA):
EVQLLESGGGLVQPGGSLRLSCAASGFTFSNYKMNWVRQAPGKGLEWVSVIYPSGGWTYYADSVK    (SEQ ID NO: 186)

GRFTISRDNSKNTLYLQMNSLRAEDTAVYYCASGYYDSSGYSRFDYWGQGTLVTVSS

H-Variable (DNA):
GAAGTTCAATTGTTAGAGTCTGGTGGCGGTCTTGTTCAGCCTGGTGGTTCTTTACGTCTTTCTTG    (SEQ ID NO: 187)
```

CGCTGCTTCCGGATTCACTTTCTCTAATTACAAGATGAATTGGGTTCGCCAAGCTCCTGGTAAAG

GTTTGGAGTGGGTTTCTGTTATCTATCCTTCTGGTGGCTGGACTTATTATGCTGACTCCGTTAAA

GGTCGCTTCACTATCTCTAGAGACAACTCTAAGAATACTCTCTACTTGCAGATGAACAGCTTAAG

GGCTGAGGACACGGCTGTGTATTACTGTGCGAGTGGTTACTATGATAGTAGTGGTTACTCCCGAT

TTGACTACTGGGGCCAGGGAACCCTGGTCACCGTCTCAAGC 7. 806C-M0044-B10
    L-Variable (AA):
QSALTQPASVSGSPGQSITISCTGTSSDVGSYNLVSWYQQHPGKAPQLMIYEGSKRPSGLSNRFS    (SEQ ID NO: 188)

GSKSDNTASLTISGLQAEDEADYYCCSYAGSSTLVFGGGTKLTVL

L-Variable (DNA):
CAGAGCGCTTTGACTCAGCCTGCCTCCGTGTCTGGGTCTCCTGGACAGTCGATCACCATCTCCTG    (SEQ ID NO: 189)

CACTGGAACCAGCAGTGATGTTGGGAGTTATAACCTTGTCTCCTGGTACCAACAACACCCAGGCA

AAGCCCCCCAACTCATGATTTATGAGGGCAGTAAGCGGCCCTCAGGACTTTCTAATCGCTTCTCT

GGCTCCAAGTCTGACAACACGGCCTCCCTGACAATCTCTGGGCTCCAGGCTGAGGACGAGGCTGA

TTATTACTGCTGCTCATATGCAGGTAGTAGCACTTTAGTATTCGGCGGAGGGACCAAGCTGACCG

TCCTA

H-Variable (AA):
EVQLLESGGGLVQPGGSLRLSCAASGFTFSRYKMGWVRQAPGKGLEWVSSIYPSGGPTYYADSVK    (SEQ ID NO: 190)

GRFTISRDNSKNTLYLQMNSLRAEDTAMYYCARSEVGAPDYWGQGTLVTVSS

H-Variable (DNA):
GAAGTTCAATTGTTAGAGTCTGGTGGCGGTCTTGTTCAGCCTGGTGGTTCTTTACGTCTTTCTTG    (SEQ ID NO: 191)

CGCTGCTTCCGGATTCACTTTCTCTCGTTACAAGATGGGTTGGGTTCGCCAAGCTCCTGGTAAAG

GTTTGGAGTGGGTTTCTTCTATCTATCCTTCTGGTGGCCCTACTTATTATGCTGACTCCGTTAAA

GGTCGCTTCACTATCTCTAGAGACAACTCTAAGAATACTCTCTACTTGCAGATGAACAGCTTAAG

GGCTGAGGACACAGCCATGTATTACTGTGCGAGAAGCGAAGTGGGAGCCCCCGACTACTGGGGCC

AGGGAACCCTGGTCACCGTCTCAAGC 8. 806C-M044-B12
L-Variable (AA):
QDIQMTQSPSTLSASVGDTVTMTCRASQSISGWLAWYQQKPGKAPNLLIFKASTLKSGVPSRFRG    (SEQ ID NO: 192)

SGSGTEFTLTISSLQPDDFATYYCQQYNSYSQTFGQGTKVEIK

L-Variable (DNA):
CAAGACATCCAGATGACCCAGTCTCCTTCCACCCTTTCTGCATCTGTAGGAGACACCGTCACCAT    (SEQ ID NO: 193)

GACTTGCCGGGCCAGTCAGAGTATTAGTGGGTGGTTGGCCTGGTATCAGCAGAAACCAGGGAAAG

CCCCTAACCTCCTGATCTTTAAGGCGTCTACTTTAAAAAGTGGGGTCCCGTCAAGGTTTCGCGGC

AGTGGATCTGGGACAGAATTCACTCTCACCATCAGCAGCCTGCAGCCTGATGATTTTGCAACTTA

TTACTGCCAACAATATAATAGTTATTCTCAGACGTTCGGCCAAGGGACCAAGGTGGAAATCAAA

H-Variable (AA):
EVQLLESGGGLVQPGGSLRLSCAASGFTFSMYKMHWVRQAPGKGLEWVSSIYPSGGYTVYADSVK    (SEQ ID NO: 194)

GRFTISRDNSKNTLYLQMNSLRAEDTAVYYCATDRWSSGGYGVDFWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 195)

CGCTGCTTCCGGATTCACTTTCTCTATGTACAAGATGCATTGGGTTCGCCAAGCTCCTGGTAAAG

GTTTGGAGTGGGTTTCTTCT

ATCTATCCTTCTGGTGGCTATACTGTTTATGCTGACTCCGTTAAAGGTCGCTTCACTATCTCTAG

AGACAACTCTAAGAATACTCTACTTGCAGATGAACAGCTTAAGGGCTGAGGACACGGCCGTGT

ATTACTGTGCCACAGACCGG

TGGAGCAGTGGCGGGTACGGTGTTGACTTCTGGGGCCAGGGAACCCTGGTCACCGTCTCAAGC 9. 806C-M0044-C07
L-Variable (AA):
QDIQMTQSPLSLPVTPGEPASISCRSSQSLLHSNGYNYLDWYLQKPGQSPQLLIYLGSNRASGVP (SEQ ID NO: 196)

DRFSGSGSGTDFTLKISRVEAEDVGVYYCMQALQTPQFGQGTKVEIK

L-Variable (DNA):
CAAGACATCCAGATGACCCAGTCTCCACTCTCCCTGCCCGTCACCCCTGGAGAGCCGGCCTCCAT (SEQ ID NO: 197)

CTCCTGCAGGTCTAGTCAGAGCCTCCTGCATAGTAATGGATACAACTATTTGGATTGGTACCTGC

AGAAGCCAGGGCAGTCTCCACAGCTCCTGATCTATTTGGGTTCTAATCGGGCCTCCGGGGTCCCT

GACAGGTTCAGTGGCAGTGGATCAGGCACAGATTTTACACTGAAAATCAGCAGAGTGGAGGCTGA

GGATGTTGGGGTTTATTACTGCATGCAAGCTCTACAAACTCCTCAGTTCGGCCAAGGGACCAAGG

TGGAAATCAAG

H-Variable (AA):
EVQLLESGGGLVQPGGSLRLSCAASGFTFSHYDMSWVRQAPGKGLEWVSYIYPSGGPTYYADSVK (SEQ ID NO: 198)

GRFTISRDNSKNTLYLQMNSLRAEDTAVYYCARGDWASRFATWGQGTTVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 199)

CGCTGCTTCCGGATTCACTTTCTCTCATTACGATATGTCTTGGGTTCGCCAAGCTCCTGGTAAAG

GTTTGGAGTGGGTTTCTTATATCTATCCTTCTGGTGGCCCTACTTATTATGCTGACTCCGTTAAA

GGTCGCTTCACTATCTCTAGAGACAACTCTAAGAATACTCTACTTGCAGATGAACAGCTTAAG

GGCTGAGGACACGGCCGTGTATTACTGTGCAAGAGGCGATTGGGCTTCTCGTTTTGCCACCTGGG

GCCAGGGGACCACGGTCACCGTCTCAAGC 10. 806C-M0044-D01
L-Variable (AA):
QYELTQPPSVSVAPGQTARITCGGNNIGIKSVNWYQQKPGQAPVLVVYDDSGRPSGIPQRFSGSN (SEQ ID NO: 200)

SGNTATLTINRVEAGDEADYYCQVWDSGSDHWVFGGGTKLTVL

L-Variable (DNA):
CAGTACGAATTGACTCAGCCACCCTCGGTGTCAGTGGCCCCAGGACAGACGGCCAGGATTACCTG (SEQ ID NO: 201)

TGGGGGAAACAACATTGGAATTAAAAGTGTGAACTGGTACCAGCAGAAGCCAGGCCAGGCCCCTG

TGCTGGTCGTCTATGATGAT

AGTGGCCGGCCCTCAGGGATCCCTCAGCGATTCTCTGGCTCCAACTCTGGGAACACGGCCACCCT

GACCATCAACAGGGTCGAAGCGGGGATGAGGCCGACTATTACTGTCAGGTGTGGGATAGTGGTA

GTGATCATTGGGTGTTCGGCGGAGGGACCAAGCTGACCGTCCTA

H-Variable (AA):
EVQLLESGGGLVQPGGSLRLSCAASGFTFSHYKMGWVRQAPGKGLEWVSSIYPSGGFTRYADSVK (SEQ ID NO: 202)

GRFTISRDNSKNTLYLQMNSLRAEDTAVYYCARNFVESSHYYHDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 203)

CGCTGCTTCCGGATTCACTTTCTCTCATTACAAGATGGGTTGGGTTCGCCAAGCTCCTGGTAAAG

-continued

GTTTGGAGTGGGTTTCTTCTATCTATCCTTCTGGTGGCTTTACTCGTTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCCAGAAATTTCGTTGAAAGTAGTCATTATTACCATG

ACTATTGGGGCCAGGGAACCCTGGTCACCGTCTCAAGC 11. 806C-M0044-E03
L-Variable (AA):
QSELTQPPSVSVAPGQTAVITCGGSNIGGKSVHWYQQKSGQAPVLVVFDDRDRPSGIPERFSGSN (SEQ ID NO: 204)

SGNTATLTITRVEVGDEADYYCQVWDSGTDHRVFGGGTRLTAL

L-Variable (DNA):
CAGAGCGAATTGACTCAGCCACCCTCGGTGTCAGTGGCCCCAGGGCAGACGGCCGTGATTACCTG (SEQ ID NO: 205)

TGGGGGGAGCAACATTGGAGGTAAAAGTGTACACTGGTACCAGCAGAAGTCAGGCCAGGCCCCTG

TGCTGGTCGTCTTTGATGATCGCGACCGGCCCTCAGGGATCCCTGAGCGATTCTCTGGCTCCAAC

TCCGGGAACACGGCCACCCTGACCATCACCAGGGTCGAAGTCGGGGATGAGGCCGACTATTACTG

TCAGGTGTGGGATAGTGGAACTGATCATCGGGTGTTCGGCGGAGGGACCAGGCTGACCGCCCTA

H-Variable (AA):
EVQLLESGGGLVQPGGSLRLSCAASGFTFSRYVMFWVRQAPGKGLEWVSGIYPSGGHTRYADSVK (SEQ ID NO: 206)

GRFTISRDNSKNTLYLQMNSLRAEDTAVYYCARRGSGGYFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 207)

CGCTGCTTCCGGATTCACTTTCTCTCGTTACGTTATGTTTTGGGTTCGCCAAGCTCCTGGTAAAG

GTTTGGAGTGGGTTTCTGGT

ATCTATCCTTCTGGTGGCCATACTCGTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGACGAGGC

TCGGGGGCTACTTTGACTACTGGGGCCAGGGCACCCTGGTCACCGTCTCAAGC 12. 806C-M0044-F03
L-Variable (AA):
QSALTQDPAVSVALGQTVRITCRGDRLRSYYSSWYQQKPRQAPVLVMFGRNNRPSGIPDRFSGST (SEQ ID NO: 208)

SGSTASLTITATQADDEADYFCSSRDGSGNFLFGGGTKLTVL

L-Variable (DNA):
CAGAGCGCTTTGACTCAGGACCCTGCTGTGTCTGTGGCCTTGGGGCAGACAGTCAGGATCACATG (SEQ ID NO: 209)

CCGAGGAGACAGACTCAGAAGTTATTATTCAAGTTGGTACCAGCAGAAGCCACGACAGGCCCCTG

TTCTTGTCATGTTTGGTAGAAACAACCGGCCCTCAGGGATCCCAGACCGATTCTCTGGCTCCACC

TCAGGAAGCACAGCTTCCTTGACCATCACTGCGACTCAGGCGGACGATGAGGCTGACTATTTCTG

TAGTTCCCGGGACGGCAGTGGTAATTTCCTCTTCGGCGGAGGGACCAAACTGACCGTCCTT

H-Variable (AA):
EVQLLESGGGLVQPGGSLRLSCAASGFTFSRYKMIWVRQAPGKGLEWVSSIYPSGGTTSYADSVK (SEQ ID NO: 210)

GRFTISRDNSKNTLYLQMNSLRAEDTAVYYCARSDLGSGWYSAEYFQHWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 211)

CGCTGCTTCCGGATTCACTTTCTCTCGTTACAAGATGATTTGGGTTCGCCAAGCTCCTGGTAAAG

GTTTGGAGTGGGTTTCTTCTATCTATCCTTCTGGTGGCACTACTTCTTATGCTGACTCCGTTAAA

GGTCGCTTCACTATCTCTAGAGACAACTCTAAGAATACTCTCTACTTGCAGATGAACAGCTTAAG

GGCTGAGGACACGGCTGTGTATTACTGTGCGAGAAGCGACCTAGGCAGTGGCTGGTATAGCGCTG

AATACTTCCAGCACTGGGGCCAGGGCACCCTGGTCACCGTCTCAAGC 13. 806C-M0044-F06
L-Variable (AA):
QDIQMTQSPGTLSLSPGERATLSCRASQSVSGNLLAWYQQKPGQAPRLLIYGASSRATGIPDRFS (SEQ ID NO: 212)

GSGSGTDFTLTITRLEPEDFAVYFCQQYGGSPPVTFGGGTKVEIK

L-Variable (DNA):
CAAGACATCCAGATGACCCAGTCTCCAGGCACCCTGTCTTTGTCTCCAGGGGAAAGAGCCACCCT (SEQ ID NO: 213)

CTCCTGCAGGGCCAGTCAGAGTGTTAGCGGCAACCTCTTAGCCTGGTATCAGCAGAAACCTGGCC

AGGCTCCCAGACTCCTCATC

TATGGTGCATCCAGCAGGGCCACTGGCATCCCAGACAGGTTCAGTGGCAGTGGGTCTGGGACAGA

CTTCACTCTCACCATCACCAGACTGGAGCCTGAAGATTTTGCAGTGTATTTCTGTCAGCAGTATG

GTGGCTCACCTCCGGTCACT

TTCGGCGGAGGGACCAAGGTGGAGATCAAA

H-Variable (AA):
EVQLLESGGGLVQPGGSLRLSCAASGFTFSSYLMIWVRQAPGKGLEWVSRIYPSGGGTEYADSVK (SEQ ID NO: 214)

GRFTISRDNSKNTLYLQMNSLRAEDTAVYYCARVTYYYDSSGYQPAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 215)

CGCTGCTTCCGGATTCACTTTCTCTTCTTACCTTATGATTTGGGTTCGCCAAGCTCCTGGTAAAG

GTTTGGAGTGGGTTTCTCGTATCTATCCTTCTGGTGGCGGTACTGAGTATGCTGACTCCGTTAAA

GGTCGCTTCACTATCTCTAGAGACAACTCTAAGAATACTCTACTTGCAGATGAACAGCTTAAG

GGCTGAGGACACGGCCGTGTATTACTGTGCGAGAGTCACGTATTACTATGATAGTAGTGGTTATC

AACCCGCTTTTGATATCTGGGGCCAAGGGACAATGGTCACCGTCTCAAGC 14. 806C-M0044-F09
L-Variable (AA):
QDIQMTQSPATLSLSPGERATLSCRASQSVSSYLAWYQQKPGQAPRLLIYDASNRATGIPARFSG (SEQ ID NO: 216)

SGSGTDFTLIISSLEPEDFAVYYCQQRSNWPRTFGQGTKVEIK

L-Variable (DNA):
CAAGACATCCAGATGACCCAGTCTCCAGCCACCCTGTCTTTGTCTCCAGGGGAAAGAGCCACCCT (SEQ ID NO: 217)

CTCCTGCAGGGCCAGTCAGAGTGTTAGCAGCTACTTAGCCTGGTACCAACAGAAACCTGGCCAGG

CTCCCAGGCTCCTCATCTATGATGCATCCAACAGGGCCACTGGCATCCCAGCCAGGTTCAGTGGC

AGTGGGTCTGGGACAGACTTCACTCTCATCATCAGCAGCCTAGAGCCTGAAGATTTTGCAGTTTA

TTATTGTCAGCAGCGTAGCAACTGGCCTCGAACGTTCGGCCAAGGGACCAAGGTGGAAATCAAA

H-Variable (AA):
EVQLLESGGGLVQPGGSLRLSCAASGFTFSHYGMTWVRQAPGKGLEWVSVIGPSGGNTMYADSVK (SEQ ID NO: 218)

GRFTISRDNSKNTLYLQMNSLRAEDTAVYYCARVWGAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 219)

CGCTGCTTCCGGATTCACTTTCTCTCATTACGGTATGACTTGGGTTCGCCAAGCTCCTGGTAAAG

GTTTGGAGTGGGTTTCTGTTATCGGTCCTTCTGGTGGCAATACTATGTATGCTGACTCCGTTAAA

GGTCGCTTCACTATCTCTAGAGACAACTCTAAGAATACTCTACTTGCAGATGAACAGCTTAAG

GGCTGAGGACACGGCCGTGTATTACTGTGCGAGAGTATGGGGTGCTTTTGATATCTGGGGCCAAG

GGACAATGGTCACCGTCTCAAGC 15. 806C-M0044-G06
L-Variable (AA):
QDIQMTQSPATLSVSPGERATLSCRASQSVYNNLAWYQQKPGQAPRLLIYDASTTATGIPARFSG (SEQ ID NO: 220)

SGSGTDFTLTITSLEPEDFAVYYCQQRSNWPSLTFGGGTKVEIK

-continued

L-Variable (DNA):
CAAGACATCCAGATGACCCAGTCTCCAGCCACCCTGTCTGTGTCTCCAGGGGAACGAGCCACCCT (SEQ ID NO: 221)

CTCCTGCAGGGCCAGTCAGAGTGTTTACAACAACTTAGCCTGGTACCAACAGAAACCTGGCCAGG

CTCCCAGGCTCCTCATCTAT

GATGCATCCACCACGGCCACTGGCATCCCAGCCAGGTTCAGTGGCAGTGGGTCTGGGACAGACTT

CACTCTCACCATCACCAGCCTAGAGCCTGAAGATTTTGCAGTTTATTACTGTCAGCAGCGTAGCA

ACTGGCCCTCGCTCACTTTC

GGCGGAGGGACCAAGGTGGAGATCAAA

H-Variable (AA):
EVQLLESGGGLVQPGGSLRLSCAASGFTFSSYKMGWVRQAPGKGLEWVSSIYPSGGWTHYADSVK (SEQ ID NO: 222)

GRFTISRDNSKNTLYLQMNSLRAEDTAVYYCARVLLHYFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 223)

CGCTGCTTCCGGATTCACTTTCTCTTCTTACAAGATGGGTTGGGTTCGCCAAGCTCCTGGTAAAG

GTTTGGAGTGGGTTTCTTCTATCTATCCTTCTGGTGGCTGGACTCATTATGCTGACTCCGTTAAA

GGTCGCTTCACTATCTCTAGAGACAACTCTAAGAATACTCTCTACTTGCAGATGAACAGCTTAAG

GGCTGAGGACACTGCAGTCTACTATTGTGCAAGAGTACTACTACACTACTTTGACTACTGGGGCC

AGGGAACCCTGGTCACCGTCTCAAGC 16. 806C-M0044-G07
    L-Variable (AA):
QDIQMTQSPSFLSASLGDRVTITCRATQGIGTFLAWYQQKAGRAPKLLIYGASTLQSGVPSRFSG (SEQ ID NO: 224)

SGSGTEFTLTISSLQPEDFATYYCQQPNSFFGQGTKLEIK

L-Variable (DNA):
CAAGACATCCAGATGACCCAGTCTCCATCCTTCCTGTCTGCATCTTTAGGAGACAGAGTCACCAT (SEQ ID NO: 225)

CACTTGTCGGGCCACTCAGGGCATCGGCACTTTTTTAGCCTGGTATCAGCAAAAAGCAGGGAGAG

CCCCTAAACTCCTGATCTATGGTGCTTCCACTTTGCAGAGTGGGGTCCCATCAAGGTTCAGCGGC

AGTGGATCTGGGACAGAATTCACTCTCACAATAAGCAGCCTGCAGCCTGAAGATTTTGCAACTTA

TTACTGTCAACAGCCTAATAGTTTTTTTGGGCAGGGGACCAAGCTGGAGATCAAA

H-Variable (AA):
EVQLLESGGGLVQPGGSLRLSCAASGFTFSSYKMGWVRQAPGKGLEWVSSIYPSGGWTHYADSVK (SEQ ID NO: 226)

GRFTISRDNSKNTLYLQMNSLRAEDTAVYYCARVLLHYFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 227)

CGCTGCTTCCGGATTCACTTTCTCTTCTTACAAGATGGGTTGGGTTCGCCAAGCTCCTGGTAAAG

GTTTGGAGTGGGTTTCTTCT

ATCTATCCTTCTGGTGGCTGGACTCATTATGCTGACTCCGTTAAAGGTCGCTTCACTATCTCTAG

AGACAACTCTAAGAATACTCTCTACTTGCAGATGAACAGCTTAAGGGCTGAGGACACTGCAGTCT

ACTATTGTGCAAGAGTACTA

CTACACTACTTTGACTACTGGGGCCAGGGAACCCTGGTCACCGTCTCAAGC 17. 806C-M0044-G11
L-Variable (AA):
QDIQMTQSPSSVSASVGDRVTITCRASQDISSWLVWYQQKPGKAPKLLIHDASNLQSGVPSRFSG (SEQ ID NO: 228)

SGSGTDFTLTINSLQPEDFATYYCQQANSFPVTFGGGTKVEIK

L-Variable (DNA):
CAAGACATCCAGATGACCCAGTCTCCATCTTCCGTGTCTGCATCTGTAGGAGACAGAGTCACCAT (SEQ ID NO: 229)

TACTTGTCGGGCGAGTCAGGATATTAGCAGTTGGTTAGTCTGGTATCAGCAGAAACCAGGGAAAG

-continued

CCCCTAAGCTCCTGATCCATGATGCATCCAATTTGCAAAGTGGGGTCCCATCAAGGTTCAGCGGC

AGTGGGTCTGGGACAGATTTTACTCTCACCATCAACAGCCTGCAGCCTGAAGATTTTGCAACTTA

CTATTGTCAACAGGCTAACAGTTTCCCGGTCACTTTCGGCGGAGGGACCAAGGTGGAGATCAAA

H-Variable (AA):
EVQLLESGGGLVQPGGSLRLSCAASGFTFSAYPMLWVRQAPGKGLEWVSSISPSGGATAYADSVK (SEQ ID NO: 230)

GRFTISRDNSKNTLYLQMNSLRAEDTAVYYCAKGSYSDYGVFESWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 231)

CGCTGCTTCCGGATTCACTTTCTCTGCTTACCCTATGCTTTGGGTTCGCCAAGCTCCTGGTAAAG

GTTTGGAGTGGGTTTCTTCT

ATCTCTCCTTCTGGTGGCGCTACTGCTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAAAGGCTCA

TACAGTGATTACGGGGTCTTTGAGTCCTGGGGCCAGGGAACCCTGGTCACCGTCTCAAGC 18. 806C-M0044-H03
L-Variable (AA):
QRVLTQPPSASGTPGQRVTISCSGSSSNVGSNNVNWYQQLPGQAPKLLIDSNNHRPSGVPDRFSG (SEQ ID NO: 232)

SKSGTSASLALSGLQSEDEADYYCATWDDNLIAPVFGGGTKLTVL

L-Variable (DNA):
CAGAGGGTCTTGACTCAGCCACCCTCAGCGTCTGGGACCCCCGGGCAGAGGGTCACCATCTCCTG (SEQ ID NO: 233)

TTCTGGAAGCAGCTCCAATGTCGGAAGTAATAATGTAAACTGGTATCAGCAGCTCCCAGGACAGG

CCCCCAAACTCCTCATCGATAGTAATAATCACCGGCCCTCAGGGGTCCCTGACCGATTCTCTGGC

TCCAAGTCTGGCACCTCAGCCTCCCTGGCCCTCAGTGGGCTCCAGTCTGAGGATGAGGCTGATTA

TTATTGTGCGACATGGGACGACAACCTGATTGCCCCGGTATTCGGCGGAGGGACCAAGCTGACCG

TCCTA

H-Variable (AA):
EVQLLESGGGLVQPGGSLRLSCAASGFTFSRYRMSWVRQAPGKGLEWVSGIVPSGGWTTYADSVK (SEQ ID NO: 234)

GRFTISRDNSKNTLYLQMNSLRAEDTAVYYCARDNYYDFWSGYYISRFGMDVWGQGTTVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 235)

CGCTGCTTCCGGATTCACTTTCTCTCGTTACCGTATGTCTTGGGTTCGCCAAGCTCCTGGTAAAG

GTTTGGAGTGGGTTTCTGGTATCGTTCCTTCTGGTGGCTGGACTACTTATGCTGACTCCGTTAAA

GGTCGCTTCACTATCTCTAGAGACAACTCTAAGAATACTCTCTACTTGCAGATGAACAGCTTAAG

GGCTGAGGACACTGCAGTCTACTATTGTGCGAGAGATAACTATTACGATTTTTGGAGTGGTTATT

ATATTTCTCGATTCGGTATGGACGTCTGGGGCCAAGGGACCACGGTCACCGTCTCAAGC 19. 806C-M0044-H05
L-Variable (AA):
QYELTQPASVSGSPGQSITISCTGSSSDVSGYNYVSWYQHHPGKAPKLMLYDVSNRPSGVSNRFS (SEQ ID NO: 236)

GSKSGNTASLTISGLQAEDEADYYCSSYTSSSTWVFGGGTKLTVL

L-Variable (DNA):
CAGTACGAATTGACTCAGCCTGCCTCCGTGTCTGGGTCTCCTGGACAGTCGATCACCATCTCCTG (SEQ ID NO: 237)

CACTGGATCCAGCAGTGACGTTAGTGGTTATAACTATGTCTCCTGGTACCAACACCACCCAGGCA

AAGCCCCCAAACTCATGCTTTATGATGTCAGTAATCGGCCCTCAGGGGTTTCTAATCGCTTCTCT

GGCTCCAAGTCTGGCAACACGGCCTCCCTGACCATCTCTGGGCTCCAGGCTGAGGACGAGGCTGA

TTATTACTGCAGCTCATATACAAGCAGCAGCACTTGGGTGTTCGGCGGAGGGACCAAGCTGACCG

TCCTA

H-Variable (AA):
EVQLLESGGGLVQPGGSLRLSCAASGFTFSSYMMFWVRQAPGKGLEWVSRIYPSGGWTYYADSVK (SEQ ID NO: 238)

GRFTISRDNSKNTLYLQMNSLRAEDTAVYYCARVTVPLDSGSYYFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 239)

CGCTGCTTCCGGATTCACTTTCTCTTCTTACATGATGTTTTGGGTTCGCCAAGCTCCTGGTAAAG

GTTTGGAGTGGGTTTCTCGTATCTATCCTTCTGGTGGCTGGACTTATTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCGAGAGTTACGGTACCCCTTGATAGTGGGAGCTACT

ACTTTGACTACTGGGGCCAGGGAACCCTGGTCACCGTCTCAAGC 20. 806C-M0044-H07
L-Variable (AA):
QDIQMTQSPSSLSASVGDRVTITCRASQGIRNDLGWYQQKPGKAPKLLIYAASSLQSGVPSRFSG (SEQ ID NO: 240)

SGSGTDFTLTISSLQPEDFATYYCLQDYNYPWTFGQGTNVEIK

L-Variable (DNA):
CAAGACATCCAGATGACCCAGTCTCCATCCTCCCTGTCTGCATCTGTAGGAGACAGAGTCACCAT (SEQ ID NO: 241)

CACTTGCCGGGCAAGTCAGGGCATTAGAAATGATTTAGGCTGGTATCAGCAGAAACCAGGGAAAG

CCCCTAAGCTCCTGATCTAT

GCTGCATCCAGTTTACAAAGTGGGGTCCCATCAAGGTTCAGCGGCAGTGGATCTGGCACAGATTT

CACTCTCACCATCAGCAGCCTGCAGCCTGAAGATTTTGCAACTTATTACTGTCTACAAGATTACA

ATTACCCGTGGACGTTCGGC

CAAGGGACCAATGTGGAAATCAAA

H-Variable (AA):
EVQLLESGGGLVQPGGSLRLSCAASGFTFSSYLMTWVRQAPGKGLEWVSSIYPSGGWTYYADSVK (SEQ ID NO: 242)

GRFTISRDNSKNTLYLQMNSLRAEDTATYYCAREMYYDFWSGYYRGFDIWGQGTTVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 243)

CGCTGCTTCCGGATTCACTTTCTCTTCTTACCTTATGACTTGGGTTCGCCAAGCTCCTGGTAAAG

GTTTGGAGTGGGTTTCTTCTATCTATCCTTCTGGTGGCTGGACTTATTATGCTGACTCCGTTAAA

GGTCGCTTCACTATCTCTAGAGACAACTCTAAGAATACTCTCTACTTGCAGATGAACAGCTTAAG

GGCTGAGGACACAGCCACATATTACTGTGCGAGAGAGATGTATTACGATTTTTGGAGTGGTTATT

ATCGAGGTTTTGATATCTGGGGCCAAGGGACCACGGTCACCGTCTCAAGC 21. 806C-M0044-H09
L-Variable (AA):
QDIQMTQSPSTLSASIGDRVTITCRASQRVSTWVAWYQQKPGRAPKLLIYMASRLESGVPSRFSG (SEQ ID NO: 244)

SGSGTEFTLTISSLQPDDFATYWCQQYNFYPRTFGQGTKVDIK

L-Variable (DNA):
CAAGACATCCAGATGACCCAGTCTCCTTCCACCCTGTCTGCATCTATAGGAGACAGAGTCACCAT (SEQ ID NO: 245)

CACTTGCCGGGCCAGTCAGCGTGTTAGTACTTGGGTGGCCTGGTATCAGCAGAAACCAGGGAGAG

CCCCAAAACTCTTGATCTATATGGCGTCTAGGTTAGAAAGTGGGGTCCCATCAAGGTTCAGCGGC

AGTGGATCTGGGACAGAGTTCACTCTCACCATAAGCAGCCTGCAGCCTGATGATTTTGCTACTTA

TTGGTGCCAACAATATAATTTTTATCCTCGGACGTTCGGCCAAGGGACCAAGGTGGACATCAAA

H-Variable (AA):
EVQLLESGGGLVQPGGSLRLSCAASGFTFSWYGMNWVRQAPGKGLEWVSSISPSGGQTPYADSVK (SEQ ID NO: 246)

GRFTISRDNSKNTLYLQMNSLRAEDTAVYYCARDLGGAYIPDSWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 247)

CGCTGCTTCCGGATTCACTTTCTCTTGGTACGGTATGAATTGGGTTCGCCAAGCTCCTGGTAAAG

GTTTGGAGTGGGTTTCTTCT

ATCTCTCCTTCTGGTGGCCAGACTCCTTATGCTGACTCCGTTAAAGGTCGCTTCACTATCTCTAG

AGACAACTCTAAGAATACTCTACTTGCAGATGAACAGCTTAAGGGCTGAGGACACGGCCGTGT

ATTACTGTGCGCGAGATCTC

GGTGGGGCCTACATACCTGACTCCTGGGGCCAGGGCACCCTGGTCACCGTCTCAAGC 22. 806C-M0045-A02
L-Variable (AA):
QDIQMTQSPSFLSASVGDRVTITCRASQGISNYLAWYQQEPGKAPKLLIYSASTLQTGVPSRFSG (SEQ ID NO: 248)

SGSGTEFTLTISSLQPEDFATYYCQQFNSYPRTFGHGTKVEFK

L-Variable (DNA):
CAAGACATCCAGATGACCCAGTCTCCTTCCTTCCTGTCTGCATCTGTGGGAGACAGAGTCACCAT (SEQ ID NO: 249)

CACTTGCCGGGCCAGTCAGGGCATTAGCAATTATTTAGCCTGGTATCAGCAAGAACCAGGGAAAG

CCCCTAAGCTCCTCATCTATTCTGCGTCCACTTTGCAAACTGGAGTCCCATCAAGGTTCAGCGGC

AGTGGATCTGGGACAGAGTTCACTCTCACAATCAGCAGCCTGCAGCCTGAGGATTTTGCAACTTA

TTACTGTCAACAGTTTAACAGTTACCCTCGAACGTTCGGCCACGGGACCAAGGTGGAATTCAAA

H-Variable (AA):
EVQLLESGGGLVQPGGSLRLSCAASGFTFSTYPMMWVRQAPGKGLEWVSVISPSGGQTSYADSVK (SEQ ID NO: 250)

GRFTISRDNSKNTLYLQMNSLRAEDTAVYYCTRGGRLNAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 251)

CGCTGCTTCCGGATTCACTTTCTCTACTTACCCTATGATGTGGGTTCGCCAAGCTCCTGGTAAAG

GTTTGGAGTGGGTTTCTGTTATCTCTCCTTCTGGTGGCCAGACTTCTTATGCTGACTCCGTTAAA

GGTCGCTTCACTATCTCTAGAGACAACTCTAAGAATACTCTACTTGCAGATGAACAGCTTAAG

GGCTGAGGACACAGCCGTGTATTACTGTACGAGAGGGGGAGGCTGAATGCTTTTGATATCTGGG

GCCAAGGGACAATGGTCACCGTCTCAAGC 23. 806C-M0045-A04
L-Variable (AA):
QSALTQDPAVSVALGQTVRFTCQGDSLRNYHPSWYQQKPGQAPVLVIYGKNNRPSGIPDRFSGSS (SEQ ID NO: 252)

SGNTASLTITGAQAEDEADYYCNSRDSSGNHVFGTGTKVTVL

L-Variable (DNA):
CAGAGCGCTTTGACTCAGGACCCTGCTGTGTCTGTGGCCTTGGGACAGACAGTCAGGTTCACTTG (SEQ ID NO: 253)

CCAAGGAGACAGCCTCAGAAATTATCATCCAAGCTGGTACCAGCAGAAGCCAGGACAGGCCCCTG

TACTTGTCATCTATGGTAAAAACAACCGGCCCTCAGGGATCCCAGACCGATTCTCTGGCTCCAGC

TCAGGAAACACAGCTTCCTTGACCATCACTGGGGCTCAGGCGGAAGATGAGGCTGACTATTACTG

TAACTCCCGGGACAGCAGTGGTAACCATGTCTTCGGAACTGGGACCAAGGTCACCGTCCTA

H-Variable (AA):
EVQLLESGGGLVQPGGSLRLSCAASGFTFSIYQMGWVRQAPGKGLEWVSRIYPSGGVTKYADSVK (SEQ ID NO: 254)

GRFTISRDNSKNTLYLQMNSLRAEDTAVYYCARDFGPGDLWSGYYDAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 255)

CGCTGCTTCCGGATTCACTTTCTCTATTTACCAGATGGGTTGGGTTCGCCAAGCTCCTGGTAAAG

GTTTGGAGTGGGTTTCTCGTATCTATCCTTCTGGTGGCGTTACTAAGTATGCTGACTCCGTTAAA

-continued

GGTCGCTTCACTATCTCTAGAGACAACTCTAAGAATACTCTACTTGCAGATGAACAGCTTAAG

GGCTGAGGACACGGCTGTGTATTACTGTGCCAGAGATTTCGGTCCGGGCGATTTATGGAGTGGTT

ATTATGATGCTTTTGATATCTGGGGCCAAGGGACAATGGTCACCGTCTCAAGC 24. 806C-M0045-B01
L-Variable (AA):
QSALTQPASASGSPGQSVTISCTGTSSDVGGYNYVSWYQQHPGKAPKLMIYEVSKRPSGVPDRFS   (SEQ ID NO: 256)

GSKSATTASLTVSGLQAEDEADYYCSSYAGSNNLIFGGGTKVTVL

L-Variable (DNA):
CAGAGCGCTTTGACTCAGCCTGCCTCCGCGTCCGGGTCTCCTGGACAGTCAGTCACCATCTCCTG   (SEQ ID NO: 257)

CACTGGAACCAGCAGTGACGTTGGTGGTTATAACTATGTCTCCTGGTACCAACAACACCCAGGCA

AAGCCCCCAAACTCATGATT

TATGAGGTCAGTAAGCGGCCCTCAGGGGTCCCTGATCGCTTCTCTGGCTCCAAGTCTGCCACCAC

GGCCTCCCTGACCGTCTCTGGGCTCCAGGCTGAGGATGAGGCTGATTATTACTGCAGCTCATATG

CAGGCAGCAACAATTTGATATTCGGCGGGGGGACCAAGGTGACCGTCCTA

H-Variable (AA):
EVQLLESGGGLVQPGGSLRLSCAASGFTFSSYQMQWVRQAPGKGLEWVSVIYPGGYTYYADSVKG   (SEQ ID NO: 258)

RFTISRDNSKNTLYLQMNSLRAEDTAVYYCARLQFYGSSAAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 259)

CGCTGCTTCCGGATTCACTTTCTCTTCTTACCAGATGCAGTGGGTTCGCCAAGCTCCTGGTAAAG

GTTTGGAGTGGGTTTCTGTTATCTATCCTGGTGGCTATACTTATTATGCTGACTCCGTTAAAGGT

CGCTTCACTATCTCTAGAGACAACTCTAAGAATACTCTACTTGCAGATGAACAGCTTAAGGGC

TGAGGACACGGCCGTGTATTACTGTGCAAGACTCCAGTTCTACGGTTCCTCTGCTGCTTTTGACA

TCTGGGGCCAAGGGACAATGGTCACCGTCTCAAGC 25. 806C-M0045-B03
L-Variable (AA):
QDIQMTQSPDTLSLSPGERATLSCRASQSISRYLAWYQQRPGQAPSLLIYDASERAAGIPARFSG   (SEQ ID NO: 260)

SGSGTDFTLTISSLEPEDFAVYYCQQRGNWPLTFGGGTKVDIR

L-Variable (DNA):
CAAGACATCCAGATGACCCAGTCTCCAGACACCCTGTCTTTGTCTCCAGGGGAAAGAGCCACCCT   (SEQ ID NO: 261)

CTCCTGCAGGGCCAGTCAGAGTATTAGTAGATACTTAGCCTGGTACCAACAAAGACCTGGCCAGG

CTCCCAGCCTCCTCATCTAT

GATGCATCCGAAAGGGCCGCTGGCATCCCAGCCAGGTTCAGTGGCAGTGGGTCTGGGACAGACTT

CACTCTCACCATCAGCAGCCTGGAGCCTGAAGATTTTGCAGTTTATTACTGTCAGCAACGTGGCA

ACTGGCCGCTCACTTTCGGC

GGAGGGACCAAGGTGGACATCAGA

H-Variable (AA):
EVQLLESGGGLVQPGGSLRLSCAASGFTFSQYPMIWVRQAPGKGLEWVSVISPSGGHTSYADSVK   (SEQ ID NO: 262)

GRFTISRDNSKNTLYLQMNSLRAEDTAVYYCARIQYYGGAFDIWGQGKMVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 263)

CGCTGCTTCCGGATTCACTTTCTCTCAGTACCCTATGATTTGGGTTCGCCAAGCTCCTGGTAAAG

GTTTGGAGTGGGTTTCTGTTATCTCTCCTTCTGGTGGCCATACTTCTTATGCTGACTCCGTTAAA

GGTCGCTTCACTATCTCTAGAGACAACTCTAAGAATACTCTACTTGCAGATGAACAGCTTAAG

-continued

GGCTGAGGACACGGCCGTGTATTACTGTGCGAGAATCCAGTACTACGGTGGGGCTTTTGATATCT

GGGGCCAAGGGAAAATGGTCACCGTCTCAAGC 26. 806C-M0045-B11
L-Variable (AA):
QDIQMTQSPATLSLSPGERATLSCRASQSVSSYLAWYQQKPGQAPRLLIYDASNRATGIPARFSG  (SEQ ID NO: 264)

SGSGTDFTLTISSLEPEDFAVYYCQQRSNWPHTFGGGTKVEIK

L-Variable (DNA):
CAAGACATCCAGATGACCCAGTCTCCAGCCACCCTGTCTTTGTCTCCAGGGGAAAGAGCCACCCT  (SEQ ID NO: 265)

CTCCTGCAGGGCCAGTCAGAGTGTTAGCAGCTACTTAGCCTGGTACCAACAGAAACCTGGCCAGG

CTCCCAGGCTCCTCATCTATGATGCATCCAACAGGGCCACTGGCATCCCAGCCAGGTTCAGTGGC

AGTGGGTCTGGGACAGACTTCACTCTCACCATCAGCAGCCTAGAGCCTGAAGATTTTGCAGTTTA

TTACTGTCAGCAGCGTAGCAACTGGCCTCACACTTTCGGCGGAGGGACCAAGGTGGAGATCAAA

H-Variable (AA):
EVQLLESGGGLVQPGGSLRLSCAASGFTFSPYGMLWVRQAPGKGLEWVSVISPSGGQTFYADSVK  (SEQ ID NO: 266)

GRFTISRDNSKNTLYLQMNSLRAEDTAVYYCARLGAEKGMDVWGQGTTVTSS

H-Variable (DNA):
GAAGTTCAATTGTTAGAGTCTGGTGGCGGTCTTGTTCAGCCTGGTGGTTCTTTACGTCTTTCTTG  (SEQ ID NO: 267)

CGCTGCTTCCGGATTCACTTTCTCTCCTTACGGTATGCTTTGGGTTCGCCAAGCTCCTGGTAAAG

GTTTGGAGTGGGTTTCTGTTATCTCTCCTTCTGGTGGCCAGACTTTTTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCGAGGCTAGGTGCGGAAAAAGGTATGGACGTCTGGG

GCCAAGGGACCACGGTCACCGTCTCAAGC 27. 806C-M0045-C02
L-Variable (AA):
QDIQMTQSPATLSVSPGERATLSCRASQSVSSNLAWYQQRPGQAPRLLIYGASSRATGIPDRFSG  (SEQ ID NO: 268)

SGSGTDFTLTISRLEPEDFAVYYCQQYGSSPRTFGQGTKVEIK

L-Variable (DNA):
CAAGACATCCAGATGACCCAGTCTCCAGCCACCCTGTCTGTGTCTCCAGGGGAAAGAGCCACCCT  (SEQ ID NO: 269)

CTCCTGCAGGGCCAGTCAGAGTGTTAGCAGCAACTTAGCCTGGTACCAGCAGAGACCTGGCCAGG

CTCCCAGGCTCCTCATCTATGGTGCATCCAGCAGGGCCACTGGCATCCCAGACAGGTTCAGTGGC

AGTGGGTCTGGGACAGACTTCACTCTCACCATCAGCAGACTGGAGCCTGAAGATTTTGCAGTGTA

TTACTGTCAGCAGTATGGTAGCTCACCTCGGACGTTCGGCCAAGGGACCAAGGTGGAAATCAAA

H-Variable (AA):
EVQLLESGGGLVQPGGSLRLSCAASGFTFSRYVMGWVRQAPGKGLEWVSSIYPSGGYTYYADSVK  (SEQ ID NO: 270)

GRFTISRDNSKNTLYLQMNSLRAEDTAVYYCAKDSPHCSGGSCYGGYYYYGMDVWGQGTTVTVSS

H-Variable (DNA):
GAAGTTCAATTGTTAGAGTCTGGTGGCGGTCTTGTTCAGCCTGGTGGTTCTTTACGTCTTTCTTG  (SEQ ID NO: 271)

CGCTGCTTCCGGATTCACTTTCTCTCGTTACGTTATGGGTTGGGTTCGCCAAGCTCCTGGTAAAG

GTTTGGAGTGGGTTTCTTCT

ATCTATCCTTCTGGTGGCTATACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAAAGATTCC

CCGCATTGTAGTGGTGGTAGCTGCTACGGGGGCTACTACTACTACGGTATGGACGTCTGGGGCCA

AGGGACCACGGTCACCGTCTCAAGC

-continued 28. 806C-M0045-C11
L-Variable (AA):
QSELTQPASVSGSPGQSITISCTGTNRDVGGYNYVSWYQQHPGKAPKLMIYDVSNRPSGVSNRFS (SEQ ID NO: 272)

GSKSGNTASLTISGLQADDEAEYYCSSYTSSGTRVFGTGTKVTVL

L-Variable (DNA):
CAGAGCGAATTGACTCAGCCTGCCTCCGTGTCTGGGTCTCCTGGACAGTCGATCACCATCTCCTG (SEQ ID NO: 273)

CACTGGAACCAACAGAGACGTTGGTGGTTATAACTATGTCTCCTGGTACCAACAACACCCAGGCA

AAGCCCCCAAACTCATGATTTATGATGTCAGTAATCGGCCCTCAGGGGTTTCTAATCGCTTCTCT

GGCTCCAAGTCTGGCAACACGGCCTCCCTGACCATCTCTGGGCTCCAGGCTGACGACGAGGCTGA

GTATTACTGCAGCTCATATACAAGCAGCGGCACTCGAGTCTTCGGAACTGGGACCAAGGTCACCG

TCCTA

H-Variable (AA):
EVQLLESGGGLVQPGGSLRLSCAASGFTFSHYIMVWVRQAPGKGLEWVSSIYPSGGVTYYADSVK (SEQ ID NO: 274)

GRFTISRDNSKNTLYLQMNSLRAEDTAVYYCARDVAGALDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 275)

CGCTGCTTCCGGATTCACTTTCTCTCATTACATTATGGTTTGGGTTCGCCAAGCTCCTGGTAAAG

GTTTGGAGTGGGTTTCTTCT

ATCTATCCTTCTGGTGGCGTTACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGATGTT

GCCGGAGCTCTTGACTACTGGGGCCAGGGAACCCTGGTCACCGTCTCAAGC 29. 806C-M0045-C12
L-Variable (AA):
QYELTQPASVSGSPGQSITISCTGTSTDVGGYNYVSWYQKHPGKAPKLMIYDVSNRPSGVSNRFS (SEQ ID NO: 276)

GSKSGNTASLTISGLQAEDEADYYCSSYTNTITVVFGGGTKLTVL

L-Variable (DNA):
CAGTACGAATTGACTCAGCCTGCCTCCGTGTCTGGGTCTCCTGGACAGTCGATCACCATCTCCTG (SEQ ID NO: 277)

CACTGGAACCAGCACTGACGTTGGTGGTTATAACTATGTCTCCTGGTACCAAAAACACCCAGGCA

AAGCCCCCAAACTCATGATTTATGATGTCAGTAACCGGCCCTCTGGGGTTTCTAATCGCTTCTCT

GGCTCCAAGTCTGGCAACACGGCCTCCCTGACCATCTCTGGGCTCCAGGCTGAGGACGAGGCTGA

CTATTACTGCAGCTCATATACAAACACCATCACCGTGGTGTTCGGCGGAGGGACCAAGCTGACCG

TCCTA

H-Variable (AA):
EVQLLESGGGLVQPGGSLRLSCAASGFTFSKYWMHWVRQAPGKGLEWVSSIYSSGGRTHYADSVK (SEQ ID NO: 278)

GRFTISRDNSKNTLYLQMNSLRAEDTAMYYCAHTDSSTWYRWYFDLWGRGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 279)

CGCTGCTTCCGGATTCACTTTCTCTAAGTACTGGATGCATTGGGTTCGCCAAGCTCCTGGTAAAG

GTTTGGAGTGGGTTTCTTCTATCTATTCTTCTGGTGGCCGTACTCATTATGCTGACTCCGTTAAA

GGTCGCTTCACTATCTCTAGAGACAACTCTAAGAATACTCTCTACTTGCAGATGAACAGCCTAAG

GGCTGAGGACACCGCCATGTATTACTGTGCACACACTGATAGCAGCACCTGGTACCGGTGGTACT

TCGATCTCTGGGGCCGTGGCACCCTGGTCACCGTCTCAAGC 30. 806C-M0045-D01
L-Variable (AA):
QDIQMTQSPSTLSSSVGDRVTITCRASQSVSNWLAWYQQKPGKAPKVLIYKASTLESGVPSRFSG (SEQ ID NO: 280)

SGSGTEFTLTISSLQPDDFATYYCQHYHRYSRTFGQGTKVEIK

L-Variable (DNA):
CAAGACATCCAGATGACCCAGTCTCCTTCCACCCTGTCTTCATCTGTAGGAGACAGAGTCACCAT (SEQ ID NO: 281)

CACTTGCCGGGCCAGTCAGAGTGTTAGTAACTGGTTGGCCTGGTATCAGCAGAAACCAGGGAAAG

CCCCTAAGGTCCTAATCTATAAGGCGTCTACTTTAGAAAGTGGGGTCCCGTCAAGGTTCAGCGGC

AGTGGATCTGGGACAGAATTCACTCTCACCATCAGCAGCCTGCAGCCTGATGATTTTGCAACTTA

TTACTGCCAACATTATCATCGTTATTCTCGAACGTTCGGCCAAGGGACCAAGGTGGAAATCAAA

H-Variable (AA):
EVQLLESGGGLVQPGGSLRLSCAASGFTFSAYKMTWVRQAPGKGLEWVSSIYPSGGWTWYADSVK (SEQ ID NO: 282)

GRFTISRDNSKNTLYLQMNSLRAEDTAVYYCARDNWQGGAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 283)

CGCTGCTTCCGGATTCACTTTCTCTGCTTACAAGATGACTTGGGTTCGCCAAGCTCCTGGTAAAG

GTTTGGAGTGGGTTTCTTCTATCTATCCTTCTGGTGGCTGGACTTGGTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCGAGAGATAACTGGCAGGGCGGTGCTTTTGACATCT

GGGGCCAAGGGACAATGGTCACCGTCTCAAGC 31. 806C-M0045-D07
L-Variable (AA):
QDIQMTQSPGTLSLSPGERATLSCRASQSVNSNQLAWYQQKPGQAPRLLIYGASNRATGIPARFS (SEQ ID NO: 284)

GSGSGTDFTLTISSLEPEDFAVYYCQQRSNFWTFGQGTKVEIK

L-Variable (DNA):
CAAGACATCCAGATGACCCAGTCTCCAGGCACCCTGTCTTTGTCTCCAGGGGAAAGAGCCACCCT (SEQ ID NO: 285)

CTCCTGCAGGGCCAGTCAGAGTGTTAACAGCAACCAGTTAGCCTGGTACCAGCAGAAACCTGGCC

AGGCTCCCAGGCTCCTCATC

TATGGTGCATCCAACAGGGCCACTGGCATCCCAGCCAGGTTCAGTGGCAGTGGGTCTGGGACAGA

CTTCACTCTCACCATCAGCAGCCTAGAGCCTGAAGATTTTGCAGTCTATTACTGTCAGCAGCGTA

GCAACTTTTGGACGTTCGGC

CAAGGGACCAAGGTGGAAATCAAA

H-Variable (AA):
EVQLLESGGGLVQPGGSLRLSCAASGFTFSRYLMMWVRQAPGKGLEWVSSIYPSGGWTYYADSVK (SEQ ID NO: 286)

GRFTISRDNSKNTLYLQMNSLRAEDTAMYYCARVAPYDSSGSVNYAFDPWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 287)

CGCTGCTTCCGGATTCACTTTCTCTCGTTACCTTATGATGTGGGTTCGCCAAGCTCCTGGTAAAG

GTTTGGAGTGGGTTTCTTCTATCTATCCTTCTGGTGGCTGGACTTATTATGCTGACTCCGTTAAA

GGTCGCTTCACTATCTCTAGAGACAACTCTAAGAATACTCTCTACTTGCAGATGAACAGCTTAAG

GGCTGAGGACACCGCCATGTATTACTGTGCCAGAGTCGCCCCTATGATAGTAGTGGTTCGGTAA

ATTACGCGTTCGACCCCTGGGGCCAGGGCACCCTGGTCACCGTCTCAAGC 32. 806C-M0045-G01
L-Variable (AA):
QDIQMTQSPSSLSASVGDRVTITCRASQNINIYLNWYQQKPGRAPSLLIYTQSNLRSGVPSRFSG (SEQ ID NO: 288)

SGYGTDFTLTISGLQPEDFATYYCQQSHSAPRTFGQGTRVEIK

-continued

L-Variable (DNA):
CAAGACATCCAGATGACCCAGTCTCCATCCTCCCTGTCTGCATCTGTAGGAGACAGAGTCACCAT  (SEQ ID NO: 289)

CACTTGCCGGGCAAGTCAGAACATTAACATCTATTTGAATTGGTATCAGCAGAAGCCAGGGAGAG

CCCCTAGCCTCCTGATTTAT

ACTCAATCCAATTTGCGAAGTGGGGTCCCATCAAGGTTCAGTGGCAGTGGATATGGCACAGATTT

CACTCTCACCATCAGCGGTCTGCAACCTGAAGATTTTGCAACTTACTACTGTCAACAGAGTCACA

GTGCCCCCCGGACGTTCGGC

CAGGGGACCAGGGTGGAAATCAAA

H-Variable (AA):
EVQLLESGGGLVQPGGSLRLSCAASGFTFSHYKMVWVRQAPGKGLEWVSVIYPSGGWTRYADSVK  (SEQ ID NO: 290)

GRFTISRDNSKNTLYLQMNSLRAEDTAVYYCAREMIDTISPGWHFDLWGRGTLVTVSS

H-Variable (DNA):
GAAGTTCAATTGTTAGAGTCTGGTGGCGGTCTTGTTCAGCCTGGTGGTTCTTTACGTCTTTCTTG  (SEQ ID NO: 291)

CGCTGCTTCCGGATTCACTTTCTCTCATTACAAGATGGTTTGGGTTCGCCAAGCTCCTGGTAAAG

GTTTGGAGTGGGTTTCTGTT

ATCTATCCTTCTGGTGGCTGGACTCGTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCAAGAGAAATG

ATTGACACTATTTCGCCCGGCTGGCACTTCGATCTCTGGGGCCGTGGCACCCTGGTCACCGTCTC

AAGC 33. 806C-M0045-G10
L-Variable (AA):
QSELTQDPAVSVALGQTVRITCQGDSLRSYYASWYQQKPGQAPVLVMYGKNNRPSGIPDRFSGSS  (SEQ ID NO: 292)

SGNTASLTITGAQAEDEADYYCQSRGSSSGNHYVFGTGTKVTVL

L-Variable (DNA):
CAGAGCGAATTGACTCAGGACCCTGCTGTGTCTGTGGCCTTGGGACAGACAGTCAGGATCACATG  (SEQ ID NO: 293)

CCAAGGAGACAGCCTCAGAAGCTATTATGCAAGCTGGTACCAGCAGAAGCCAGGACAGGCCCCTG

TACTTGTCATGTATGGTAAAAACAACCGGCCCTCAGGGATCCCAGACCGATTCTCTGGCTCCAGT

TCAGGAAACACAGCTTCCTTGACCATCACTGGGGCTCAGGCGGAAGATGAGGCTGACTATTACTG

TCAGTCCCGGGGCAGCAGCAGTGGTAACCATTATGTCTTC

GGAACTGGGACCAAGGTCACCGTCCTA

H-Variable (AA):
EVQLLESGGGLVQPGGSLRLSCAASGFTFSRYQMMWVRQAPGKGLEWVSSIYPSGGFTRYADSVK  (SEQ ID NO: 294)

GRFTISRDNSKNILYLQMNSLRAEDTAVYYCAKSYYYGSGTYHYSYYGMDVWGQGTTVTVSS

H-Variable (DNA):
GAAGTTCAATTGTTAGAGTCTGGTGGCGGTCTTGTTCAGCCTGGTGGTTCTTTACGTCTTTCTTG  (SEQ ID NO: 295)

CGCTGCTTCCGGATTCACTTTCTCTCGTTACCAGATGATGTGGGTTCGCCAAGCTCCTGGTAAAG

GTTTGGAGTGGGTTTCTTCT

ATCTATCCTTCTGGTGGCTTTACTCGTTATGCTGACTCCGTTAAAGGTCGCTTCACTATCTCTAG

AGACAACTCTAAGAATATTCTCTACTTGCAGATGAACAGCTTAAGGGCTGAGGACACGGCCGTAT

ATTACTGTGCGAAATCATAT

TACTATGGGTCGGGGACCTATCATTACTCTTACTACGGTATGGACGTCTGGGGCCAAGGGACCAC

GGTCACCGTCTCAAGC 34. 806C-M0046-A11
L-Variable (AA):
QDIQMTQSPGTLSLSPGERATLSCRASQSVSSTYLAWYQQKPGQAPRLLIYGASSRATGIPDRFT    (SEQ ID NO: 296)

GSGSGTDFTLTISRLEPEDFAVYYCQHYGSSPLTFGGGTKVEIK

L-Variable (DNA):
CAAGACATCCAGATGACCCAGTCTCCAGGCACCTTGTCTTTGTCTCCAGGGGAAAGAGCCACCCT    (SEQ ID NO: 297)

CTCCTGCAGGGCCAGTCAGAGTGTTAGTAGCACCTACTTAGCCTGGTACCAGCAGAAACCTGGCC

AGGCTCCCAGGCTCCTCATCTATGGTGCATCCAGCAGGGCCACTGGCATCCCAGACAGGTTCACT

GGCAGTGGGTCTGGGACAGACTTCACTCTCACCATCAGCAGACTGGAGCCTGAAGATTTTGCAGT

GTATTACTGTCAGCACTATGGTAGCTCACCGCTCACTTTCGGCGGAGGGACCAAGGTGGAGATCA

AA

H-Variable (AA):
EVQLLESGGGLVQPGGSLRLSCAASGFTFSRYRMDWVRQAPGKGLEWVSGIYPSGGHTYYADSVK    (SEQ ID NO: 298)

GRFTISRDNSKNTLYLQMNSLRAEDTATYYCARLYLWGSYPTQVAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG    (SEQ ID NO: 299)

CGCTGCTTCCGGATTCACTTTCTCTCGTTACCGTATGGATTGGGTTCGCCAAGCTCCTGGTAAAG

GTTTGGAGTGGGTTTCTGGTATCTATCCTTCTGGTGGCCATACTTATTATGCTGACTCCGTTAAA

GGTCGCTTCICTATCTCTAGAGACAACTCTAAGAATACTCTCTACTTGCAGATGAACAGCTTAAG

GGCTGAGGACACAGCCACGTATTACTGTGCGAGACTTTACCTTTGGGGAGTTATCCCACCCAGG

TTGCTTTTGATATCTGGGGCCAAGGGACAATGGTCACCGTCTCAAGC 35. 806C-M0046-B06
L-Variable (AA):
QDIQMTQSPATLSVSPGERATLSCRASQSVSSNLAWYQQKPGQAPRLLIYGASTRATGIPARFSG    (SEQ ID NO: 300)

SGSGTDFTLTISSLEPEDFAVYYCQQRSNWPLTFGGGTKVEIK

L-Variable (DNA):
CAAGACATCCAGATGACCCAGTCTCCAGCCACCCTGTCTGTGTCTCCAGGGGAAAGAGCCACCCT    (SEQ ID NO: 301)

CTCCTGCAGGGCCAGTCAGAGTGTTAGCAGCAACTTAGCCTGGTACCAGCAGAAACCTGGCCAGG

CTCCCAGGCTCCTCATCTATGGTGCATCCACCAGGGCCACTGGTATCCCAGCCAGGTTCAGTGGC

AGTGGGTCTGGGACAGACTTCACTCTCACCATCAGCAGCCTAGAGCCTGAAGATTTTGCAGTTTA

TTACTGTCAGCAGCGTAGCAACTGGCCGCTCACTTTCGGCGGAGGGACCAAGGTGGAGATCAAA

H-Variable (AA):
EVQLLESGGGLVQPGGSLRLSCAASGFTFSMYPMLWVRQAPGKGLEWVSSIYPSGGMTYYADSVK    (SEQ ID NO: 302)

GRFTISRDNSKNTLYLQMNSLRAEDTAVYYCARQGYYDSSGWTFDYWGQGTLVTVSS

H-Variable (DNA):
GAAGTTCAATTGTTAGAGTCTGGTGGCGGTCTTGTTCAGCCTGGTGGTTCTTTACGTCTTTCTTG    (SEQ ID NO: 303)

CGCTGCTTCCGGATTCACTTTCTCTATGTACCCTATGCTTTGGGTTCGCCAAGCTCCTGGTAAAG

GTTTGGAGTGGGTTTCTTCTATCTATCCTTCTGGTGGCATGACTTATTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCGAGACAAGGTTACTATGATAGTAGTGGGTGGACCT

TTGACTACTGGGGCCAGGGAACCCTGGTCACCGTCTCAAGC 36. 806C-M0046-B10
L-Variable (AA):
QDIQMTQSPATLSLSPGERATLSCRASQSVSSYLAWYQQKPGQAPRLLIYDASNRATGIPARFSG    (SEQ ID NO: 304)

SGSGTDFTLTISSLEPEDFAVYYCQQRSNWPLTFGGGTKVEIK

L-Variable (DNA):
CAAGACATCCAGATGACCCAGTCTCCAGCCACCCTGTCTTTGTCTCCAGGGGAAAGAGCCACCCT   (SEQ ID NO: 305)

CTCCTGCAGGGCCAGTCAGAGTGTTAGCAGCTACTTAGCCTGGTACCAACAGAAACCTGGCCAGG

CTCCCAGGCTCCTCATCTAT

GATGCATCCAACAGGGCCACTGGCATCCCAGCCAGGTTCAGTGGCAGTGGGTCTGGGACAGACTT

CACTCTCACCATCAGCAGCCTAGAGCCTGAAGATTTTGCAGTTTATTACTGTCAGCAGCGTAGCA

ACTGGCCGCTCACTTTCGGC

GGAGGGACCAAGGTGGAGATCAAA

H-Variable (AA):
EVQLLESGGGLVQPGGSLRLSCAASGFTFSAYVMNWVRQAPGKGLEWVSGIYSSGGYIYYADSVK   (SEQ ID NO: 306)

GRFTISRDNSKNTLYLQMNSLRAEDTATYYCARRHFNGVGFDLWGQGTMVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 307)

CGCTGCTTCCGGATTCACTTTCTCTGCTTACGTTATGAATTGGGTTCGCCAAGCTCCTGGTAAAG

GTTTGGAGTGGGTTTCTGGTATCTATTCTTCTGGTGGCTATATTTATTATGCTGACTCCGTTAAA

GGTCGCTTCACTATCTCTAGAGACAACTCTAAGAATACTCTCTACTTGCAGATGAACAGCTTAAG

GGCTGAGGACACAGCCACATATTACTGTGCGAGAAGACATTTCAACGGGGTTGGTTTTGATCTCT

GGGGCCAAGGGACAATGGTCACCGTCTCAAGC 37. 806C-M0046-G12
L-Variable (AA):
QDIQMTQSPGTLSLSPGERATLSCRASQSVSSSNLAWYQQKPGQAPRLLIYGASTRATGIPARFS   (SEQ ID NO: 308)

GSGSGTEFTLTISSLQSEDFAVYYCQLYKTFGGGTKVEIK

L-Variable (DNA):
CAAGACATCCAGATGACCCAGTCTCCAGGCACCCTGTCTTTGTCTCCAGGGGAAAGAGCCACCCT   (SEQ ID NO: 309)

CTCCTGCAGGGCCAGTCAGAGTGTTAGCAGCAGCAACTTAGCCTGGTACCAGCAGAAACCTGGCC

AGGCTCCCAGGCTCCTCATCTATGGTGCATCCACCAGGGCCACTGGTATCCCAGCCAGGTTCAGT

GGCAGTGGGTCTGGGACAGAGTTCACTCTCACCATCAGCAGCCTGCAGTCTGAAGATTTTGCAGT

TTATTACTGTCAGCTGTATAAGACTTTCGGCGGAGGGACCAAGGTGGAGATCAAA

H-Variable (AA):
EVQLLESGGGLVQPGGSLRLSCAASGFTFSNYKMNWVRQAPGKGLEWVSVIYPSGGGTYYADSVK   (SEQ ID NO: 310)

GRFTISRDNSKNTLYLQMNSLRAEDTAVYYCARVGYSSGWFLFYGMDVWGQGTTVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 311)

CGCTGCTTCCGGATTCACTTTCTCTAATTACAAGATGAATTGGGTTCGCCAAGCTCCTGGTAAAG

GTTTGGAGTGGGTTTCTGTT

ATCTATCCTTCTGGTGGCGGTACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCTGTGT

ATTACTGTGCGAGAGTCGGG

TATAGCAGTGGCTGGTTTCTCTTTTACGGTATGGACGTCTGGGGCCAAGGGACCACGGTCACCGT

CTCAAGC 38. 806C-M0046-H03
L-Variable (AA):
QSALTQPRSVSGSPGQSVTISCTGSNTDVGRYNFVSWYQQKPGKAPKLIIYDVYKRPSGVPDRFS   (SEQ ID NO: 312)

GSKSGNTASLTISGLQADDEADYYCCSYARASTFSYVFGIGTEVTVL

L-Variable (DNA):
CAGAGCGCTTTGACTCAGCCTCGCTCAGTGTCCGGGTCTCCTGGACAGTCAGTCACCATCTCCTG (SEQ ID NO: 313)

CACTGGATCCAATACTGATGTTGGTCGATACAATTTTGTTTCCTGGTACCAACAAAAGCCAGGCA

AAGCCCCCAAACTCATAATTTATGATGTCTATAAGCGGCCCTCAGGGGTCCCTGATCGCTTCTCT

GGCTCCAAGTCTGGCAACACGGCCTCCCTGACCATCTCTGGGCTCCAGGCTGACGATGAGGCTGA

TTATTACTGCTGCTCATATGCTCGCGCCTCCACTTTCTCTTATGTCTTCGGAATTGGGACCGAAG

TCACCGTCCTT

H-Variable (AA):
EVQLLESGGGLVQPGGSLRLSCAASGFTFSSYIMVWVRQAPGKGLEWVSSIYPSGGHTPYADSVK (SEQ ID NO: 314)

GRFTISRDNSKNTLYLQMNSLRAEDTAVYYCARQTGGYAHFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 315)

CGCTGCTTCCGGATTCACTTTCTCTTCTTACATTATGGTTTGGGTTCGCCAAGCTCCTGGTAAAG

GTTTGGAGTGGGTTTCTTCTATCTATCCTTCTGGTGGCCATACTCCTTATGCTGACTCCGTTAAA

GGTCGCTTCACTATCTCTAGAGACAACTCTAAGAATACTCTACTTGCAGATGAACAGCTTAAG

GGCTGAGGACACGGCCGTGTATTACTGTGCGAGACAGACGGGTGGCTACGCCCACTTTGATTACT

GGGGCCAGGGAACCCTGGTCACCGTCTCAAGC 39. 806C-M0046-H10
L-Variable (AA):
QDIQMTQSPSSLSASVGDRVTMTCRASQGIGTYLAWYQQKPGKVPKLLIYAASTLQSGVPSRFSG (SEQ ID NO: 316)

SGSGTDFTLTISSLQPEDVATYYCQKYNSAPRPFGQGTQVEIK

L-Variable (DNA):
CAAGACATCCAGATGACCCAGTCTCCGTCCTCCCTGTCTGCATCTGTAGGAGACAGAGTCACCAT (SEQ ID NO: 317)

GACTTGCCGGGCGAGTCAGGGCATTGGCACTTATTTAGCCTGGTATCAGCAGAAACCAGGGAAAG

TTCCTAAGCTCCTGATCTATGCTGCGTCCACTTTGCAATCAGGGGTCCCATCTCGGTTCAGTGGC

AGTGGATCTGGGACGGATTTCACTCTCACCATCAGCAGCCTGCAGCCTGAAGATGTTGCAACTTA

TTACTGTCAAAAGTATAACAGTGCCCCTCGTCCGTTCGGCCAAGGGACCCAGGTGGAAATCAAA

H-Variable (AA):
EVQLLESGGGLVQPGGSLRLSCAASGFTFSSYVMHWVRQAPGKGLEWVSSIYPSGGWTLYADSVK (SEQ ID NO: 318)

GRFTISRDNSKNTLYLQMNSLRAEDTAVYYCARAVGPFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 319)

CGCTGCTTCCGGATTCACTTTCTCTTCTTACGTTATGCATTGGGTTCGCCAAGCTCCTGGTAAAG

GTTTGGAGTGGGTTTCTTCT

ATCTATCCTTCTGGTGGCTGGACTCTTTATGCTGACTCCGTTAAAGGTCGCTTCACTATCTCTAG

AGACAACTCTAAGAATACTCTACTTGCAGATGAACAGCTTAAGGGCTGAGGACACGGCCGTGT

ATTACTGTGCGAGAGCAGTG

GGACCTTTTGACTACTGGGGCCAGGGCACCCTGGTCACCGTCTCAAGC 40. 806C-M0046-H11
L-Variable (AA):
QYELIQPPSVSGIPGQRVTISCSGNNSNFGSNTVTWYQQLPGTAPKLLIYSDSRRPSGVPDRFSG (SEQ ID NO: 320)

SRSDTSASLAISGLQSEDEAEYHCAAWDDSLNGVFGGGTKLTVL

L-Variable (DNA):
CAGTACGAATTGATTCAGCCACCCTCAGTGTCTGGGATCCCCGGACAGAGGGTCACCATCTCTTG (SEQ ID NO: 321)

TTCTGGAAACAACTCCAACTTCGGAAGTAATACTGTAACCTGGTACCAGCAGCTCCCAGGAACGG

```
                          -continued
CCCCCAAACTCCTCATCTAT

AGTGATAGTCGGCGGCCCTCAGGGGTCCCTGACCGATTCTCTGGCTCCAGGTCTGACACCTCAGC

CTCCCTGGCCATCAGTGGGCTCCAGTCTGAGGATGAGGCTGAGTATCACTGTGCAGCATGGGATG

ACAGCCTAAATGGGGTGTTC

GGCGGAGGGACCAAGCTGACCGTCCTA

H-Variable (AA):
EVQLLESGGGLVQPGGSLRLSCAASGFTFSRYKMEWVRQAPGKGLEWVSVIYPSGGHTNYADSVK   (SEQ ID NO: 322)

GRFTISRDNSKNTLYLQMNSLRAEDTAVYYCARGGYYDILTGYYKYYFDYWGQGTLVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 323)

CGCTGCTTCCGGATTCACTTTCTCTCGTTACAAGATGGAGTGGGTTCGCCAAGCTCCTGGTAAAG

GTTTGGAGTGGGTTTCTGTTATCTATCCTTCTGGTGGCCATACTAATTATGCTGACTCCGTTAAA

GGTCGCTTCACTATCTCTAGAGACAACTCTAAGAATACTCTACTTGCAGATGAACAGCTTAAG

GGCTGAGGACACGGCCGTGTATTACTGTGCGAGAGGAGGCTATTACGATATTTTGACTGGTTATT

ATAAGTACTACTTTGACTACTGGGGCCAGGGAACCCTGGTCACCGTCTCAAGC 41. 806C-M0047-B03
L-Variable (AA):
QDIQMTQSPSPLSASVGDSVTITCRASQRIGSYLNWYQQNPGKAPKLLIYGASNLESGVPSRFSG   (SEQ ID NO: 324)

RGSGTEFTLTITSLQPEDFATYFCQQTSSVSPLTFGQGTRLDIK

L-Variable (DNA):
CAAGACATCCAGATGACCCAGTCTCCATCCCCCCTGTCTGCATCTGTAGGAGACAGTGTCACCAT   (SEQ ID NO: 325)

CACTTGTCGGGCAAGTCAGAGGATTGGCAGCTACTTGAATTGGTATCAGCAGAATCCAGGCAAAG

CCCCAAAACTCCTGATCTAC

GGTGCATCCAATTTGGAAAGTGGGGTCCCATCAAGGTTCAGTGGCCGTGGATCTGGGACAGAGTT

CACACTCACCATCACCAGTCTGCAACCTGAAGATTTTGCAACTTATTTCTGTCAACAGACCTCCA

GTGTCTCCCCGCTCACCTTC

GGCCAAGGGACACGACTGGACATTAAA

H-Variable (AA):
EVQLLESGGGLVQPGGSLRLSCAASGFTFSSYKMSWVRQAPGKGLEWVSVIYPSGGWTWYADSVK   (SEQ ID NO: 326)

GRFTISRDNSKNTLYLQMNSLRAEDTAVYYCARMMYYYDSSGYLRADAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 327)

CGCTGCTTCCGGATTCACTTTCTCTTCTTACAAGATGTCTTGGGTTCGCCAAGCTCCTGGTAAAG

GTTTGGAGTGGGTTTCTGTTATCTATCCTTCTGGTGGCTGGACTTGGTATGCTGACTCCGTTAAA

GGTCGCTTCACTATCTCTAGAGACAACTCTAAGAATACTCTACTTGCAGATGAACAGCTTAAG

GGCTGAGGACACGGCCGTGTATTACTGTGCGAGAATGATGTATTACTATGATAGTAGTGGTTACC

TAAGGGCTGATGCTTTTGATATCTGGGGCCAAGGGACAATGGTCACCGTCTCAAGC 42. 806C-M0047-D01
L-Variable (AA):
QDIQMTQSPGTLSTSIGDRVTITCRASQSINEWLAWYQQKPGKAPKLLIYAASSLQSGVPSRFSG   (SEQ ID NO: 328)

SGSGTDFTLTISRLEPEDFAVYYCQQYGSSPALTFGGGTKVEIK

L-Variable (DNA):
CAAGACATCCAGATGACCCAGTCTCCAGGCACCCTCTCTACATCTATAGGAGACAGAGTCACCAT   (SEQ ID NO: 329)

CACTTGCCGGGCCAGTCAGAGTATTAATGAGTGGTTGGCCTGGTATCAGCAGAAACCAGGGAAAG

CCCCTAAGCTCCTGATCTATGCTGCATCCAGTTTGCAAAGTGGGGTCCCATCAAGGTTCAGTGGC
```

-continued

AGTGGATCTGGGACAGACTTCACTCTCACCATCAGCAGACTGGAGCCTGAAGATTTTGCAGTGTA

TTACTGTCAGCAGTATGGTAGCTCACCCGCGCTCACTTTCGGCGGAGGGACCAAGGTGGAGATCA

AA

H-Variable (AA):
EVQLLESGGGLVQPGGSLRLSCAASGFTFSAYKMMWVRQAPGKGLEWVSSIYPSGGWTYYADSVK (SEQ ID NO: 330)

GRFTISRDNSKNTLYLQMNSLRAEDTALYYCARSMGYGDAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 331)

CGCTGCTTCCGGATTCACTTTCTCTGCTTACAAGATGATGTGGGTTCGCCAAGCTCCTGGTAAAG

GTTTGGAGTGGGTTTCTTCTATCTATCCTTCTGGTGGCTGGACTTATTATGCTGACTCCGTTAAA

GGTCGCTTCACTATCTCTAGAGACAACTCTAAGAATACTCTCTACTTGCAGATGAACAGTTTAAG

GGCTGAGGACACCGCCTTGTATTACTGTGCGAGATCAATGGGCTATGGTGATGCTTTTGATATCT

GGGGCCAAGGGACAATGGTCACCGTCTCAAGC 43. 806C-M0047-D03
L-Variable (AA):
QDIQMTQSPSSLSASVGDRVTITCRASQTIRSYLNWYQQKPGKAPKLLIYAASNLQSGVPSRFSG (SEQ ID NO: 332)

SGSGTDFTLTISSLQPEDFATYYCQQSYSMSSWTFGQGTNLEIK

L-Variable (DNA):
CAAGACATCCAGATGACCCAGTCTCCATCCTCCCTGTCTGCATCTGTAGGAGACAGAGTCACAAT (SEQ ID NO: 333)

CACTTGCCGGGCAAGTCAGACCATTAGAAGCTATTTAAATTGGTATCAGCAGAAACCAGGGAAAG

CCCCTAAGCTCCTGATCTATGCTGCATCCAATTTGCAAAGTGGGGTCCCATCAAGGTTCAGTGGC

AGTGGGTCTGGGACAGACTTCACTCTCACCATCAGCAGTCTGCAACCTGAAGATTTTGCAACTTA

CTACTGTCAACAGAGTTACAGTATGTCGTCGTGGACTTTTGGCCAGGGGACCAACCTGGAGATCA

AA

H-Variable (AA):
EVQLLESGGGLVQPGGSLRLSCAASGFTFSVYPMAWVRQAPGKGLEWVSWISPGGKTYYADSVKG (SEQ ID NO: 334)

RFTISRDNSKNTLYLQMNSLRAEDTATYYCARGSRHYDKFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 335)

CGCTGCTTCCGGATTCACTTTCTCTGTTTACCCTATGGCTTGGGTTCGCCAAGCTCCTGGTAAAG

GTTTGGAGTGGGTTTCTTGGATCTCTCCTGGTGGCAAGACTTATTATGCTGACTCCGTTAAAGGT

CGCTTCACTATCTCTAGAGACAACTCTAAGAATACTCTCTACTTGCAGATGAACAGCTTAAGGGC

TGAGGACACAGCCACGTATTACTGTGCGAGAGGGAGCCGCCACTATGATAAGTTTGACTACTGGG

GCCAGGGAACCCTGGTCACCGTCTCAAGC 44. 806C-M0047-E10
L-Variable (AA):
QSVLTQPASVSGSPGQSITISCTGTSSDVGGYNYVSWYQQHPGKAPKVMIYDVSNRPSGVSNRFS (SEQ ID NO: 336)

GSKSGNTASLTISGLLAEDEADYYCSSYTSTATYVLGTGTRVTVV

L-Variable (DNA):
CAGAGCGTCTTGACTCAGCCTGCCTCCGTGTCTGGGTCTCCTGGACAGTCGATCACCATCTCCTG (SEQ ID NO: 337)

CACTGGAACCAGCAGTGACGTTGGTGGTTACAACTATGTCTCCTGGTACCAACAACACCCAGGCA

AAGCCCCCAAAGTCATGATTTATGATGTCAGTAATCGGCCCTCAGGGGTTTCTAATCGCTTCTCT

GGCTCCAAGTCTGGCAACACGGCCTCCCTGACCATCTCGGGGCTCCTGGCTGAGGACGAAGCTGA

TTATTACTGCAGCTCATATACAAGTACAGCCACCTATGTC

CTCGGAACTGGGACCAGGGTCACCGTCGTA

-continued

H-Variable (AA):
EVQLLESGGGLVQPGGSLRLSCAASGFTFSHYKMAWVRQAPGKGLEWVSVIYPSGGATYYADSVK (SEQ ID NO: 338)

GRFTISRDNSKNTLYLQMNSLRAEDTAVYYCARALPGGYFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 339)

CGCTGCTTCCGGATTCACTTTCTCTCATTACAAGATGGCTTGGGTTCGCCAAGCTCCTGGTAAAG

GTTTGGAGTGGGTTTCTGTT

ATCTATCCTTCTGGTGGCGCTACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCAAGGGCCTTA

CCGGGGGGCTACTTTGACTACTGGGGCCAGGGCACCCTGGTCACCGTCTCAAGC 45. 806C-M0047-G09
L-Variable (AA):
QDIQMTQSPGTLSLSPGERATLACRASQSVSSSYLAWYQQKPGQAPRLLIYGASNRATGIPDRFS (SEQ ID NO: 340)

GSGSDTDFTLKISRVEAEDVGTYYCMQATFWPYAFGQGTKLEIK

L-Variable (DNA):
CAAGACATCCAGATGACCCAGTCTCCAGGCACCCTGTCTTTGTCTCCAGGGGAAAGAGCCACCCT (SEQ ID NO: 341)

CGCCTGCAGGGCCAGTCAGAGTGTTAGCAGCAGCTACTTAGCCTGGTACCAGCAGAAACCTGGCC

AGGCTCCCAGGCTCCTCATC

TATGGTGCATCCAACAGGGCCACTGGCATCCCAGACAGATTCAGCGGCAGTGGGTCAGACACTGA

TTTCACACTGAAAATCAGCAGGGTGGAGGCTGAGGATGTTGGGACTTATTACTGCATGCAAGCTA

CATTCTGGCCGTACGCTTTT

GGCCAGGGGACCAAGCTGGAGATCAAA

H-Variable (AA):
EVQLLESGGGLVQPGGSLRLSCAASGFTFSWYRMVWVRQAPGKGLEWVSGIYPSGGFTSYADSVK (SEQ ID NO: 342)

GRFTISRDNSKNTLYLQMNSLRAEDTAVYYCARVYYYDSSGYYFRGGFDPWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 343)

CGCTGCTTCCGGATTCACTTTCTCTTGGTACCGTATGGTTTGGGTTCGCCAAGCTCCTGGTAAAG

GTTTGGAGTGGGTTTCTGGT

ATCTATCCTTCTGGTGGCTTTACTTCTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGTGTAT

TACTATGATAGTAGTGGTTATTATTTCCGTGGGGGGTTCGACCCCTGGGGCCAGGGCACCCTGGT

CACCGTCTCAAGC 46. 806C-M0053-A02
L-Variable (AA):
QSVLTQPPSVSGIPGQRVTISCSGNNSNFGSNTVTWYQQLPGTAPKLLIYSDSRRPSGVPDRFSG (SEQ ID NO: 344)

SRSDTSASLAISGLQSEDEAEYHCAAWDDSLNGVFGGGTKLTVL

L-Variable (DNA):
CAGAGCGTCTTGACTCAGCCACCCTCAGTGTCTGGGATCCCCGGACAGAGGGTCACCATCTCTTG (SEQ ID NO: 345)

TTCTGGAAACAACTCCAACTTCGGAAGTAATACTGTAACCTGGTACCAGCAGCTCCCAGGAACGG

CCCCCAAACTCCTCATCTAT

AGTGATAGTCGGCGGCCCTCAGGGGTCCCTGACCGATTCTCTGGCTCCAGGTCTGACACCTCAGC

CTCCCTGGCCATCAGTGGGCTCCAGTCTGAGGATGAGGCTGAGTATCACTGTGCAGCATGGGATG

-continued

ACAGCCTAAATGGGGTGTTC

GGCGGAGGGACCAAGCTGACCGTCCTA

H-Variable (AA):
EVQLLESGGGLVQPGGSLRLSCAASGFTFSQYLMQWVRQAPGKGLEWVSSIYPSGGATYYADSVK (SEQ ID NO: 346)

GRFTISRDNSKNTLYLQMNSLRAEDTAVYYCATRKDGYSRSAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 347)

CGCTGCTTCCGGATTCACTTTCTCTCAGTACCTTATGCAGTGGGTTCGCCAAGCTCCTGGTAAAG

GTTTGGAGTGGGTTTCTTCT

ATCTATCCTTCTGGTGGCGCTACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCAACAAGGAAG

GATGGCTACAGTCGAAGTGCTTTTGATATCTGGGGCCAAGGGACAATGGTCACCGTCTCAAGC 47. 806C-M0053-A03
L-Variable (AA):
QDIQMTQSPGTLSLSPGERATLSCRASQSVSSSYLAWYQQKPGQAPRLLIYGASSRATGIPDRFS (SEQ ID NO: 348)

GSGSGTDFTLTISRLEPEDFAVYYCQQRGNWPRTFGQGTKVEIK

L-Variable (DNA):
CAAGACATCCAGATGACCCAGTCTCCAGGCACCCTGTCTTTGTCTCCAGGGGAAAGAGCCACCCT (SEQ ID NO: 349)

CTCCTGCAGGGCCAGTCAGAGTGTTAGCAGCAGCTACTTAGCCTGGTACCAGCAGAAACCTGGCC

AGGCTCCCAGGCTCCTCATC

TATGGTGCATCCAGCAGGGCCACTGGCATCCCAGACAGGTTCAGTGGCAGTGGGTCTGGGACAGA

CTTCACTCTCACCATCAGCAGACTGGAGCCTGAAGATTTTGCAGTGTATTACTGTCAGCAGCGTG

GCAACTGGCCCCGGACGTTC

GGCCAAGGGACCAAGGTGGAAATCAAA

H-Variable (AA):
EVQLLESGGGLVQPGGSLRLSCAASGFTFSHYVMWWVRQAPGKGLEWVSGIYPSGWTVYADSVKG (SEQ ID NO: 350)

RFTISRDNSKNTLYLQMNSLRAEDTAVYYCAKDLGGTRAFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 351)

CGCTGCTTCCGGATTCACTTTCTCTCATTACGTTATGTGGTGGGTTCGCCAAGCTCCTGGTAAAG

GTTTGGAGTGGGTTTCTGGT

ATCTATCCTTCTGGTTGGACTGTTTATGCTGACTCCGTTAAAGGTCGCTTCACTATCTCTAGAGA

CAACTCTAAGAATACTCTCTACTTGCAGATGAACAGCTTAAGGGCTGAGGACACGGCCGTGTATT

ACTGTGCGAAAGATCTGGGG

GGGACCCGTGCCTTTGACTACTGGGGCCAGGGAACCCTGGTCACCGTCTCAAGC 48. 806C-M0053-A05
L-Variable (AA):
QSELTQPASVSGSPGQSITISCTGTSSDDVGGYNYVSWYQQHPGKAPKLLIYDVSDRPSGVSNRF (SEQ ID NO: 352)

SGSKSGNTASLTISGLLAEDEADYYCGSYRVTSVSRSYVFGTETK

L-Variable (DNA):
CAGAGCGAATTGACTCAGCCTGCCTCCGTGTCTGGGTCTCCTGGACAGTCGATCACCATCTCCTG (SEQ ID NO: 353)

CACTGGAACCAGCAGTGACGACGTTGGTGGTTATAACTATGTCTCCTGGTACCAACAACACCCAG

GCAAAGCCCCCAAACTCCTG

ATTTATGATGTCAGTGATCGGCCCTCAGGGGTTTCTAATCGCTTCTCTGGCTCCAAGTCTGGCAA

-continued
```
CACGGCCTCCCTGACCATCTCTGGGCTCCTGGCTGAGGACGAGGCTGATTATTATTGCGGCTCAT

ATCGCGTCACCAGCGTCAGC

AGATCCTATGTCTTCGGAACTGAGACCAAG

H-Variable (AA):
EVQLLESGGGLVQPGGSLRLSCAASGFTFSNYPMTWVRQAPGKGLEWVSRIYPSGGYTYYADSVK   (SEQ ID NO: 354)

GRFTISRDNSKNTLYLQMNSLRAEDTAVYYCARGRIAALDYWGQGTLVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 355)

CGCTGCTTCCGGATTCACTTTCTCTAATTACCCTATGACTTGGGTTCGCCAAGCTCCTGGTAAAG

GTTTGGAGTGGGTTTCTCGT

ATCTATCCTTCTGGTGGCTATACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGGGGTCGT

ATAGCAGCTCTTGACTACTGGGGCCAGGGCACCCTGGTCACCGTCTCAAGC 49. 806C-M0053-A09
L-Variable (AA):
QSALTQGPTVSVALGQTVRITCQGDTLRYFSASWYQQKPGQAPVLVIFGANNRPSGIPDRFSGSR   (SEQ ID NO: 356)

SGVTASLTITGAQAEDEAEYYCNSRDGSGNWLFGGGTKLSVL

L-Variable (DNA):
CAGAGCGCTTTGACTCAGGGCCCTACTGTGTCTGTGGCCTTGGGACAGACAGTCAGGATCACATG   (SEQ ID NO: 357)

TCAAGGAGACACCCTCAGATACTTTTCTGCAAGTTGGTACCAGCAGAAGCCGGGACAGGCCCCTG

TCCTTGTCATCTTTGGGGCA

AACAATCGGCCCTCAGGGATCCCAGACCGGTTCTCTGGCTCCAGGTCAGGAGTCACCGCTTCCTT

GACCATCACTGGGGCTCAGGCGGAAGATGAGGCTGAGTATTACTGTAACTCCCGGGACGGCAGTG

GTAATTGGCTGTTCGGCGGA

GGGACCAAGCTGTCCGTCCTC

H-Variable (AA):
EVQLLESGGGLVQPGGSLRLSCAASGFTFSRYVMHWVRQAPGKGLEWVSVIYPSGGATLYADSVK   (SEQ ID NO: 358)

GRFTISRDNSKNTLYLQMNSLRAEDTAVYYCARGQYSSGWYTEGWFDPWGQGTLVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 359)

CGCTGCTTCCGGATTCACTTTCTCTCGTTACGTTATGCATTGGGTTCGCCAAGCTCCTGGTAAAG

GTTTGGAGTGGGTTTCTGTT

ATCTATCCTTCTGGTGGCGCTACTCTTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGGCCAG

TATAGCAGTGGCTGGTACACGGAGGGCTGGTTCGACCCCTGGGGCCAGGGCACCCTGGTCACCGT

CTCAAGC 50. 806C-M0053-B09
L-Variable (AA):
QYELTQPPSASGTPGQRVTISCSGSSSNIGSNNVNWYQQLPGTAPKLLIYSNDQRPSGVPDRFSG   (SEQ ID NO: 360)

SKSATSASLAISGLQSEDEADYHCAAWDDSLNGPVFGGGTKLTVL

L-Variable (DNA):
CAGTACGAATTGACTCAGCCACCCTCAGCGTCTGGGACCCCCGGGCAGAGGGTCACCATCTCTTG   (SEQ ID NO: 361)

TTCTGGAAGCAGCTCCAACATCGGAAGTAATAATGTCAACTGGTACCAGCAACTCCCAGGAACGG
```

-continued

CCCCCAAACTCCTCATCTAC

AGTAATGATCAGCGGCCCTCAGGGGTCCCTGACCGATTCTCTGGCTCCAAGTCTGCCACCTCAGC

CTCCCTGGCCATCAGTGGGCTCCAGTCTGAGGATGAGGCTGATTATCACTGTGCAGCATGGGATG

ACAGCCTGAATGGTCCGGTG

TTCGGCGGAGGGACCAAGCTGACCGTCCTA

H-Variable (AA):
EVQLLESGGGLVQPGGSLRLSCAASGFTFSRYKMQWVRQAPGKGLEWVSSIYPSGGITYYADSVK (SEQ ID NO: 362)

GRFTISRDNSKNTLYLQMNSLRAEDTAVYYCARGRGTTRAFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 363)

CGCTGCTTCCGGATTCACTTTCTCTCGTTACAAGATGCAGTGGGTTCGCCAAGCTCCTGGTAAAG

GTTTGGAGTGGGTTTCTTCT

ATCTATCCTTCTGGTGGCATTACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGGACGA

GGAACGACGCGGGCTTTTGACTACTGGGGCCAGGGAACCCTGGTCACCGTCTCAAGC 51. 806C-M0053-B11
L-Variable (AA):
QYELTQPPSVSVAPGQTAKILCGGNDIGRKFVHWYQQKPGQAPVLVVFDDSDRPSGIPERFSGSN (SEQ ID NO: 364)

SGSTATLTISGVEAGDEADYFCQVWDLSSDHWVFGGGTKLTVL

L-Variable (DNA):
CAGTACGAATTGACTCAGCCACCCTCGGTGTCAGTGGCCCCAGGACAGACGGCCAAGATTCTCTG (SEQ ID NO: 365)

TGGGGGAAACGACATTGGAAGAAAGTTTGTTCACTGGTACCAGCAGAAGCCAGGCCAGGCCCCTG

TGCTGGTCGTCTTTGATGAT

AGCGACCGGCCCTCAGGGATCCCTGAGCGATTCTCTGGCTCCAATTCTGGGAGCACGGCCACCCT

GACCATCAGCGGGGTCGAAGCCGGGGATGAGGCCGACTATTTCTGTCAGGTGTGGGATCTTAGTA

GTGATCATTGGGTGTTCGGC

GGAGGGACCAAGCTGACCGTCCTA

H-Variable (AA):
EVQLLESGGGLVQPGGSLRLSCAASGFTFSDYAMHWVRQAPGKGLEWVSRIGSSGGHTSYADSVK (SEQ ID NO: 366)

GRFTISRDNSKNTLYLQMNSLRAEDTAMYYCATDYYYDSSGYYYPAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 367)

CGCTGCTTCCGGATTCACTTTCTCTGATTACGCTATGCATTGGGTTCGCCAAGCTCCTGGTAAAG

GTTTGGAGTGGGTTTCTCGT

ATCGGTTCTTCTGGTGGCCATACTTCTTATGCTGACTCCGTTAAAGGTCGCTTCACTATCTCTAG

AGACAACTCTAAGAATACTCTCTACTTGCAGATGAACAGCTTAAGGGCTGAGGACACCGCCATGT

ATTACTGTGCGACTGACTAT

TACTATGATAGTAGTGGTTATTACTACCCTGCTTTTGATATCTGGGGCCAAGGGACAATGGTCAC

CGTCTCAAGC 52. 806C-M0053-D03
L-Variable (AA):
QDIQMTQSPGTLSLSPGERATLSCRASQSVSSSYLAWYQQKPGQAPRLLIYGASSRATGIPDRFS (SEQ ID NO: 368)

GSGSGTDFTLTISRLEPEDFAVYYCQQYGSSPLFGGGTKVEIK

-continued

L-Variable (DNA):
CAAGACATCCAGATGACCCAGTCTCCAGGCACCCTGTCTTTGTCTCCAGGGGAAAGAGCCACCCT   (SEQ ID NO: 369)

CTCCTGCAGGGCCAGTCAGAGTGTTAGCAGCAGCTACTTAGCCTGGTACCAGCAGAAACCTGGCC

AGGCTCCCAGGCTCCTCATC

TATGGTGCATCCAGCAGGGCCACTGGCATCCCAGACAGGTTCAGTGGCAGTGGGTCTGGGACAGA

CTTCACTCTCACCATCAGCAGACTGGAGCCTGAAGATTTTGCAGTGTATTACTGTCAGCAGTATG

GTAGCTCACCTCTGTTCGGC

GGAGGGACCAAGGTGGAGATCAAA

H-Variable (AA):
EVQLLESGGGLVQPGGSLRLSCAASGFTFSRYAMMWVRQAPGKGLEWVSSIYPSGGSTYYADSVK   (SEQ ID NO: 370)

GRFTISRDNSKNTLYLQMNSLRAEDTAVYYCARVQGGAGAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 371)

CGCTGCTTCCGGATTCACTTTCTCTCGTTACGCTATGATGTGGGTTCGCCAAGCTCCTGGTAAAG

GTTTGGAGTGGGTTTCTTCT

ATCTATCCTTCTGGTGGCTCTACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGTACAG

GGGGGGGCGGGTGCTTTTGATATCTGGGGCCAAGGGACAATGGTCACCGTCTCAAGC 53. 806C-M0053-D06
L-Variable (AA):
QDIQMTQSPSSLSASVGDRVTITCRASQSINTYLNWYQHKPGKAPELLISAASSLQSGVPSRFSG   (SEQ ID NO: 372)

SGSGTDFTLTISSLRPEDFATYYCQQSHSISTFTFGPGTKVDVK

L-Variable (DNA):
CAAGACATCCAGATGACCCAGTCTCCATCTTCCCTGTCTGCATCTGTCGGAGACAGAGTCACCAT   (SEQ ID NO: 373)

CACTTGCCGGGCAAGTCAGAGCATTAACACCTATTTAAATTGGTATCAGCACAAACCAGGGAAGG

CCCCTGAGCTCCTGATCTCT

GCTGCATCTAGCTTGCAAAGTGGGGTCCCATCAAGGTTCAGTGGCAGTGGATCTGGGACAGATTT

CACTCTCACCATCAGCAGTCTGCGACCTGAAGATTTTGCGACTTACTACTGTCAACAGAGTCACA

GTATATCCACATTCACTTTC

GGCCCTGGGACCAAAGTGGATGTCAAG

H-Variable (AA):
EVQLLESGGGLVQPGGSLRLSCAASGFTFSRYKMHWVRQAPGKGFEWVSSIVPSGGWTYYADSVK   (SEQ ID NO: 374)

GRFTISRDNSKNTLYLQMNSLRAEDTAVYYCARQMYYYDSSGYYVGRFDIWGQGTTVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 375)

CGCTGCTTCCGGATTCACTTTCTCTCGTTACAAGATGCATTGGGTTCGCCAAGCTCCTGGTAAAG

GTTTTGAGTGGGTTTCTTCT

ATCGTTCCTTCTGGTGGCTGGACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGACAAATG

TATTACTATGATAGTAGTGGTTATTATGTCGGGCGTTTTGATATCTGGGGCCAAGGGACCACGGT

CACCGTCTCAAGC

-continued 54. 806C-M0053-D12
L-Variable (AA):
QDIQMTQSPATLSLSPGERATLSCRASQSVSSYLAWYQQKPGQAPRLLIYDASNRATGIPARFSG (SEQ ID NO: 376)

SGSGTDFTLTISSLEPEDFAVYYCQQRSNWPPRITFGGGTKVEIK

L-Variable (DNA):
CAAGACATCCAGATGACCCAGTCTCCAGCCACCCTGTCTTTGTCTCCAGGGGAAAGAGCCACCCT (SEQ ID NO: 377)

CTCCTGCAGGGCCAGTCAGAGTGTTAGCAGCTACTTAGCCTGGTACCAACAGAAACCTGGCCAGG

CTCCCAGGCTCCTCATCTAT

GATGCATCCAACAGGGCCACTGGCATCCCAGCCAGGTTCAGTGGCAGTGGGTCTGGGACAGACTT

CACTCTCACCATCAGCAGCCTAGAGCCTGAAGATTTTGCAGTTTATTACTGTCAGCAGCGTAGCA

ACTGGCCTCCCCGGATCACT

TTCGGCGGAGGGACCAAGGTGGAGATCAAA

H-Variable (AA):
EVQLLESGGGLVQPGGSLRLSCAASGFTFSSYMMFWVRQAPGKGLEWVSRIYPSGGWTYYADSVK (SEQ ID NO: 378)

GRFTISRDNSKNTLYLQMNSLRAEDTAVYYCARVTVPLDSGSYYFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 379)

CGCTGCTTCCGGATTCACTTTCTCTTCTTACATGATGTTTTGGGTTCGCCAAGCTCCTGGTAAAG

GTTTGGAGTGGGTTTCTCGT

ATCTATCCTTCTGGTGGCTGGACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGTTACG

GTACCCCTTGATAGTGGGAGCTACTACTTTGACTACTGGGGCCAGGGAACCCTGGTCACCGTCTC

AAGC 55. 806C-M0053-E03
L-Variable (AA):
QDIQMTQSPATLSLSPGERATLSCRASQSVSSSYLAWYQQKPGQAPRLLIYGASSRATGIPDRFS (SEQ ID NO: 380)

GSGSGTDFTLTISRLEPEDFAVYYCQQYGSSPQLTFGGGTKVEIK

L-Variable (DNA):
CAAGACATCCAGATGACCCAGTCTCCAGCCACCCTGTCTTTGTCTCCAGGGGAAAGAGCCACCCT (SEQ ID NO: 381)

CTCCTGCAGGGCCAGTCAGAGTGTTAGCAGCAGCTACTTAGCCTGGTACCAGCAGAAACCTGGCC

AGGCTCCCAGGCTCCTCATC

TATGGTGCATCCAGCAGGGCCACTGGCATCCCAGACAGGTTCAGTGGCAGTGGGTCTGGGACAGA

CTTCACTCTCACCATCAGCAGACTGGAGCCTGAAGATTTTGCAGTGTATTACTGTCAGCAGTATG

GTAGCTCACCCCAGCTCACT

TTCGGCGGAGGGACCAAGGTGGAGATCAAA

H-Variable (AA):
EVQLLESGGGLVQPGGSLRLSCAASGFTFSNYKMWWVRQAPGKGLEWVSSIYPSGGWTQYADSVK (SEQ ID NO: 382)

GRFTISRDNSKNTLYLQMNSLRAEDTAVYYCAKDVGGGGFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 383)

CGCTGCTTCCGGATTCACTTTCTCTAATTACAAGATGTGGTGGGTTCGCCAAGCTCCTGGTAAAG

GTTTGGAGTGGGTTTCTTCT

ATCTATCCTTCTGGTGGCTGGACTCAGTATGCTGACTCCGTTAAAGGTCGCTTCACTATCTCTAG

AGACAACTCTAAGAATACTCTCTACTTGCAGATGAACAGCTTAAGGGCTGAGGACACTGCCGTGT

ATTACTGTGCGAAAGATGTT

GGGGGGGGTGGCTTTGACTACTGGGGCCAGGGAACCCTGGTCACCGTCTCAAGC 56. 806C-M0053-E04
L-Variable (AA):
QDIQMTQSPATLSVSPGERATLSCRASQSVSSNLAWYQQKPGQAPRLLIYGASTRATGIPARFSG (SEQ ID NO: 384)

SGSGTEFTLTISSLQSEDFAVYYCLTRVTFGGGTKVELK

L-Variable (DNA):
CAAGACATCCAGATGACCCAGTCTCCAGCCACCCTGTCTGTGTCTCCAGGGGAAAGAGCCACCCT (SEQ ID NO: 385)

CTCCTGCAGGGCCAGTCAGAGTGTTAGCAGCAACTTAGCCTGGTACCAGCAGAAACCTGGCCAGG

CTCCCAGGCTCCTCATCTAT

GGTGCATCCACCAGGGCCACTGGTATCCCAGCCAGGTTCAGTGGCAGTGGGTCTGGGACAGAATT

CACTCTCACCATCAGCAGCCTGCAGTCTGAAGATTTTGCAGTTTATTACTGTCTAACACGAGTCA

CTTTCGGCGGAGGGACCAAG

GTTGAGCTCAAG

H-Variable (AA):
EVQLLESGGGLVQPGGSLRLSCAASGFTFSHYKMGWVRQAPGKGLEWVSSIYPSGGWTTYADSVK (SEQ ID NO: 386)

GRFTISRDNSKNTLYLQMNSLRAEDTAVYYCARDSPLVVPAAIKSGAYYYGMDVWGQGTTVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 387)

CGCTGCTTCCGGATTCACTTTCTCTCATTACAAGATGGGTTGGGTTCGCCAAGCTCCTGGTAAAG

GTTTGGAGTGGGTTTCTTCT

ATCTATCCTTCTGGTGGCTGGACTACTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGATTCC

CCCCTAGTAGTACCAGCTGCTATTAAGAGCGGGGCCTACTACTACGGTATGGACGTCTGGGGCCA

AGGGACCACGGTCACCGTCTCAAGC 57. 806C-M0053-E08
L-Variable (AA):
QSVLTQPPSASGTPGQRVSISCSGSSYNIGVYDVYWYQQLPGTAPKLLIYTNNQRPSGVPDRFSG (SEQ ID NO: 388)

SKSGTSASLSISGLRSEDEADYYCAAWDDSLAGWVFGGGTKVTVL

L-Variable (DNA):
CAGAGCGTCTTGACTCAGCCACCCTCAGCGTCTGGGACCCCCGGGCAGAGGGTCAGTATCTCTTG (SEQ ID NO: 389)

TTCTGGAAGCAGCTACAACATCGGAGTTTATGATGTATACTGGTACCAGCAGCTCCCAGGAACGG

CCCCCAAACTCCTCATCTAT

ACCAATAATCAGCGGCCCTCAGGGGTCCCTGACCGATTCTCTGGCTCCAAGTCTGGCACCTCAGC

CTCCCTGTCCATCAGTGGGCTCCGGTCCGAGGATGAGGCTGATTATTACTGTGCAGCCTGGGATG

ACAGCCTGGCTGGTTGGGTG

TTCGGCGGAGGGACCAAGGTGACCGTCCTA

H-Variable (AA):
EVQLLESGGGLVQPGGSLRLSCAASGFTFSRYVMLWVRQAPGKGLEWVSVIYPSGGYTYYADSVK (SEQ ID NO: 390)

GRFTISRDNSKNTLYLQMNSLRAEDTAVYYCARGVLRAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 391)

CGCTGCTTCCGGATTCACTTTCTCTCGTTACGTTATGCTTTGGGTTCGCCAAGCTCCTGGTAAAG

GTTTGGAGTGGGTTTCTGTT

ATCTATCCTTCTGGTGGCTATACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGGGGTA

CTAAGAGCTTTTGATATCTGGGGCCAAGGGACAATGGTCACCGTCTCAAGC 58. 806C-M0053-F04
L-Variable (AA):
QDIQMTQSPATLSLSPGERATLSCRASQSVSSYLAWYQQKPGQAPRLLIYDTSNRATGIPARFSG (SEQ ID NO: 392)

SGSGTDFTLTISSLEPEDFAVYYCQQRSNWPITFGQGTRLEIK

L-Variable (DNA):
CAAGACATCCAGATGACCCAGTCTCCAGCCACCCTGTCTTTGTCTCCGGGGGAAAGAGCCACCCT (SEQ ID NO: 393)

CTCCTGCAGGGCCAGTCAGAGTGTTAGCAGCTACTTAGCCTGGTACCAACAGAAACCTGGCCAGG

CTCCCAGGCTCCTCATCTAT

GATACATCCAACAGGGCCACTGGCATCCCAGCCAGGTTCAGTGGCAGTGGGTCTGGGACAGACTT

CACTCTCACCATCAGCAGTCTAGAGCCTGAAGATTTTGCAGTTTATTACTGTCAGCAGCGTAGCA

ACTGGCCGATCACCTTCGGC

CAAGGGACACGACTGGAGATTAAA

H-Variable (AA):
EVQLLESGGGLVQPGGSLRLSCAASGFTFSGYGMYWVRQAPGKGLEWVSVISPSGGYTHYADSVK (SEQ ID NO: 394)

GRFTISRDNSKNTLYLQMNSLRAEDTAVYYCARAYSSGWYLDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 395)

CGCTGCTTCCGGATTCACTTTCTCTGGTTACGGTATGTATTGGGTTCGCCAAGCTCCTGGTAAAG

GTTTGGAGTGGGTTTCTGTT

ATCTCTCCTTCTGGTGGCTATACTCATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGCGTAT

AGCAGTGGCTGGTACCTTGACTACTGGGGCCAGGGAACCCTGGTCACCGTCTCAAGC 59. 806C-M0053-F05
L-Variable (AA):
QSVLTQPPSLSVSPGQTARIACSGDNLGSRYISWYQQKSGQSPVVVLYQDYRRPSGIPERISGSN (SEQ ID NO: 396)

SGNTATLTISGTQAVDEADYYCQAWDRSTAVFGGGTRLTVL

L-Variable (DNA):
CAGAGCGTCTTGACTCAGCCACCCTCACTGTCCGTGTCCCCAGGGCAGACAGCCCGCATCGCCTG (SEQ ID NO: 397)

CTCTGGAGATAATTTGGGGAGTAGATATATTTCCTGGTATCAGCAGAAGTCAGGCCAGTCTCCTG

TGGTGGTCCTCTATCAAGAC

TACAGACGGCCCTCAGGGATCCCTGAGCGAATCTCTGGCTCCAACTCTGGGAACACAGCCACTCT

GACCATCAGCGGGACTCAGGCTGTGGATGAGGCGGACTATTATTGTCAGGCGTGGGACAGAAGCA

CTGCGGTGTTCGGCGGAGGG

ACCAGGCTGACCGTCCTA

H-Variable (AA):
EVQLLESGGGLVQPGGSLRLSCAASGFTFSSYMMFWVRQAPGKGLEWVSRIYPSGGWTYYADSVK (SEQ ID NO: 398)

GRFTISRDNSKNTLYLQMNSLRAEDTAVYYCARVTVPLDSGSYYFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 399)

CGCTGCTTCCGGATTCACTTTCTCTTCTTACATGATGTTTTGGGTTCGCCAAGCTCCTGGTAAAG

-continued

GTTTGGAGTGGGTTTCTCGT

ATCTATCCTTCTGGTGGCTGGACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGTTACG

GTACCCCTTGATAGTGGGAGCTACTACTTTGACTACTGGGGCCAGGGAACCCTGGTCACCGTCTC

AAGC 60. 806C-M0053-F06
L-Variable (AA):
QDIQMTQSPDTLSLSPGERATLSCRAHSVTNNRLAWYQQKPGQSPRLLIYGASNRAAGIPARFS (SEQ ID NO: 400)

GSGSGTDFTLTISSLEPEDFAVYYCQQRSHWLYTFGQGTKLEIK

L-Variable (DNA):
CAAGACATCCAGATGACCCAGTCTCCAGACACCCTGTCTTTGTCTCCAGGAGAAAGAGCCACCCT (SEQ ID NO: 401)

CTCATGCAGGGCCAGTCACAGTGTTACTAACAACCGCTTAGCCTGGTACCAGCAGAAACCTGGCC

AGTCTCCCAGGCTCCTCATC

TATGGTGCATCCAACAGGGCCGCTGGCATCCCTGCCAGGTTCAGTGGCAGTGGCTCTGGGACAGA

CTTCACTCTCACCATCAGCAGCCTAGAGCCTGAAGATTTTGCAGTTTATTACTGTCAACAGCGTA

GCCACTGGCTTTACACTTTT

GGCCAGGGGACCAAGCTGGAGATCAAA

H-Variable (AA):
EVQLLESGGGLVQPGGSLRLSCAASGFTFSSYIMIWVRQAPGKGLEWVSSIYPSGGQTYYADSVK (SEQ ID NO: 402)

GRFTISRDNSKNTLYLQMNSLRAEDMAVYYCARKNGYNNVFDVWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 403)

CGCTGCTTCCGGATTCACTTTCTCTTCTTACATTATGATTTGGGTTCGCCAAGCTCCTGGTAAAG

GTTTGGAGTGGGTTTCTTCT

ATCTATCCTTCTGGTGGCCAGACTTATTATGCTGACTCCGTTAAAGGTCGCTTCACTATCTCTAG

AGACAACTCTAAGAATACTCTCTACTTGCAGATGAACAGCTTAAGGGCTGAGGACATGGCTGTGT

ATTACTGTGCAAGAAAAAAT

GGCTACAATAATGTATTTGATGTCTGGGGCCAAGGGACAATGGTCACCGTCTCAAGC 61. 806C-M0053-F08
L-Variable (AA):
QSALTQPASVSGSPGQSITISCTGTSSDVGSYNLVSWYQQHPGKAPKLMIYEGSKRPSGVSNRFS (SEQ ID NO: 404)

GSKSGNTASLTISGLQAEDEADYYCCSYAGSSTYVFGTGTKVTVL

L-Variable (DNA):
CAGAGCGCTTTGACTCAGCCTGCCTCCGTGTCTGGGTCTCCTGGACAGTCGATCACCATCTCCTG (SEQ ID NO: 405)

CACTGGAACCAGCAGTGATGTTGGGAGTTATAACCTTGTCTCCTGGTACCAACAGCACCCAGGCA

AAGCCCCCAAACTCATGATT

TATGAGGGCAGTAAGCGGCCCTCAGGGGTTTCTAATCGCTTCTCTGGCTCCAAGTCTGGCAACAC

GGCCTCCCTGACAATCTCTGGGCTCCAGGCTGAGGACGAGGCTGATTATTACTGCTGCTCATATG

CAGGTAGTAGCACTTATGTC

TTCGGAACTGGGACCAAGGTCACCGTCCTA

H-Variable (AA):
EVQLLESGGGLVQPGGSLRLSCAASGFTFSRYPMLWVRQAPGKGLEWVSSIYPSGGWTSYADSVK (SEQ ID NO: 406)

GRFTISRDNSKNTLYLQMNSLRAEDTAVYYCTTPTHNWNDDPDAFDIWGQGTTVTVSS

-continued

H-Variable (DNA):
GAAGTTCAATTGTTAGAGTCTGGTGGCGGTCTTGTTCAGCCTGGTGGTTCTTTACGTCTTTCTTG (SEQ ID NO: 407)

CGCTGCTTCCGGATTCACTTTCTCTCGTTACCCTATGCTTTGGGTTCGCCAAGCTCCTGGTAAAG

GTTTGGAGTGGGTTTCTTCT

ATCTATCCTTCTGGTGGCTGGACTTCTTATGCTGACTCCGTTAAAGGTCGCTTCACTATCTCTAG

AGACAACTCTAAGAATACTCTCTACTTGCAGATGAACAGCTTAAGGGCTGAGGACACAGCCGTGT

ATTACTGTACCACCCCTACC

CACAACTGGAACGATGACCCTGATGCTTTTGATATCTGGGGCCAAGGGACCACGGTCACCGTCTC

AAGC 62. 806C-M0053-G04
L-Variable (AA):
QSVLTQPPSVSVAPGQTATITCGGNNIGTKSVHWYQQKPGQAPVFVYDDNDRPSGIPERFSGSNS (SEQ ID NO: 408)

GNTATMTISRVEAGDEADYYCQVWDPTGDQYVFGSGTKVTVL

L-Variable (DNA):
CAGAGCGTCTTGACTCAGCCACCCTCGGTGTCAGTGGCCCCAGGACAGACGGCCACGATTACCTG (SEQ ID NO: 409)

TGGGGGAAACAACATTGGAACTAAAAGTGTACACTGGTACCAGCAGAAGCCAGGCCAGGCCCCTG

TCTTCGTCTATGATGATAAT

GACCGGCCCTCAGGGATCCCTGAGCGATTCTCTGGCTCCAACTCCGGGAACACGGCCACCATGAC

CATCAGCAGGGTCGAAGCCGGGGATGAGGCCGACTATTATTGTCAGGTGTGGGATCCTACTGGTG

ATCAGTATGTCTTCGGAAGT

GGGACCAAGGTCACCGTCCTA

H-Variable (AA):
EVQLLESGGGLVQPGGSLRLSCAASGFTFSKYKMLWVRQAPGKGLEWVSVIYPSGGYTYYADSVK (SEQ ID NO: 410)

GRFTISRDNSKNTLYLQMNSLRAEDTAVYYCARVVVPAFYYYYMDVWGKGTTVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 411)

CGCTGCTTCCGGATTCACTTTCTCTAAGTACAAGATGCTTTGGGTTCGCCAAGCTCCTGGTAAAG

GTTTGGAGTGGGTTTCTGTT

ATCTATCCTTCTGGTGGCTATACTTACTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGTAGTA

GTACCAGCTTTCTACTACTACTACTACATGGACGTCTGGGGCAAAGGGACCACGGTCACCGTCTC

AAGC 63. 806C-M0053-G05
L-Variable (AA):
QSELTQPASVSGSPGQSITISCTGTSSDVGGYNYVSWYQQHPGKAPKLMIYEVSNRPSGVSNRFS (SEQ ID NO: 412)

GSKSGNTASLTISGLQAEDEADYYCSSYTSSSTLGGVFGGGTKLTVL

L-Variable (DNA):
CAGAGCGAATTGACTCAGCCTGCCTCCGTGTCTGGGTCTCCTGGACAGTCGATCACCATCTCCTG (SEQ ID NO: 413)

CACTGGAACCAGCAGTGACGTTGGTGGTTATAACTATGTCTCCTGGTACCAACAGCACCCAGGCA

AAGCCCCCAAACTCATGATT

TATGAGGTCAGTAATCGGCCCTCAGGGGTTTCTAATCGCTTCTCTGGCTCCAAGTCTGGCAACAC

GGCCTCCCTGACCATCTCTGGGCTCCAGGCTGAGGACGAGGCTGATTATTACTGCAGCTCATATA

CAAGCAGCAGCACTCTCGGG

GGGGTATTCGGCGGAGGGACCAAGCTGACCGTCCTA

-continued

H-Variable (AA):
EVQLLESGGGLVQPGGSLRLSCAASGFTFSKYKMDWVRQAPGKGLEWVSSIYPSGGFTYYADSVK (SEQ ID NO: 414)

GRFTISRDNSKNTLYLQMNSLRAEDTAVYYCAREKMATMDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 415)

CGCTGCTTCCGGATTCACTTTCTCTAAGTACAAGATGGATTGGGTTCGCCAAGCTCCTGGTAAAG

GTTTGGAGTGGGTTTCTTCT

ATCTATCCTTCTGGTGGCTTTACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCAAGAGAGAAG

ATGGCTACAATGGACTACTGGGGCCAGGGCACCCTGGTCACCGTCTCAAGC 64. 806C-M0054-A08
L-Variable (AA):
QYELTQPASVSGSPGQSITISCTGTSSDVGGCNYVSWYQQHPGKAPQLLIYDVSYRPSGVSNRFS (SEQ ID NO: 416)

GSKSGNTASLTISGLQADDEADYYCSSCTSSSTLFGTGTKVTVL

L-Variable (DNA):
CAGTACGAATTGACTCAACCTGCCTCCGTGTCTGGGTCTCCTGGACAGTCGATCACCATCTCCTG (SEQ ID NO: 417)

CACTGGAACCAGCAGTGACGTTGGTGGTTGTAACTATGTCTCCTGGTACCAACAACACCCAGGCA

AAGCCCCCCAACTCTTGATT

TATGATGTCAGTTATCGGCCCTCAGGGGTTTCTAATCGCTTCTCTGGCTCCAAGTCTGGCAACAC

GGCCTCCCTGACCATCTCTGGGCTCCAGGCTGACGACGAGGCTGATTACTACTGCAGCTCATGTA

CAAGTAGCAGCACTCTCTTC

GGAACTGGGACCAAGGTCACCGTCCTA

H-Variable (AA):
EVQLLESGGGLVQPGGSLRLSCAASGFTFSRYVMHWVRQAPGKGLEWVSRIYPSGGWTYYADSVK (SEQ ID NO: 418)

GRFTISRDNSKNTLYLQMNSLRAEDTAVYYCARVAGESNGMDVWGQGTTVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 419)

CGCTGCTTCCGGATTCACTTTCTCTCGTTACGTTATGCATTGGGTTCGCCAAGCTCCTGGTAAAG

GTTTGGAGTGGGTTTCTCGT

ATCTATCCTTCTGGTGGCTGGACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGTGGCT

GGGGAGTCGAACGGTATGGACGTCTGGGGCCAAGGGACCACGGTCACCGTCTCAAGC 65. 806C-M0054-B06
L-Variable (AA):
QDIQMTQSPSSLSASIGDRVTVTCRTSQSIDTYLNWYQQKPGQAPNLLIYGASSLESGVPSRFSG (SEQ ID NO: 420)

SGSGTDFTLTISSLQPEDFATYYCQQSYTTSYTFGRGTTLEIQ

L-Variable (DNA):
CAAGACATCCAGATGACCCAGTCTCCATCCTCCCTGTCAGCATCTATAGGAGACAGAGTCACCGT (SEQ ID NO: 421)

CACTTGCCGGACAAGTCAGAGCATTGACACCTATTTAAATTGGTATCAGCAAAAACCAGGGCAAG

CCCCTAACCTCCTGATCTAT

GGTGCATCCAGTTTGGAAAGTGGGGTCCCATCAAGGTTCAGTGGCAGTGGATCTGGGACAGATTT

CACTCTCACCATCAGCAGTCTGCAACCTGAAGATTTTGCAACTTACTACTGTCAACAGAGTTACA

-continued

CTACCTCCTACACTTTTGGC

CGGGGGACCACGCTGGAGATCCAA

H-Variable (AA):
EVQLLESGGGLVQPGGSLRLSCAASGFTFSIYKMQWVRQAPGKGLEWVSSIYPSGGATYYADSVK (SEQ ID NO: 422)

GRFTISRDNSKNTLYLQMNSLRAEDTAVYYCARQTYYYDSSGYFRNAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 423)

CGCTGCTTCCGGATTCACTTTCTCTATTTACAAGATGCAGTGGGTTCGCCAAGCTCCTGGTAAAG

GTTTGGAGTGGGTTTCTTCT

ATCTATCCTTCTGGTGGCGCTACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGACAAACG

TATTACTATGATAGTAGTGGTTATTTCCGCAATGCTTTTGATATCTGGGGCCAAGGGACAATGGT

CACCGTCTCAAGC 66. 806C-M0054-B08
L-Variable (AA):
QSVLTQAASVSGSPGQSITLSCTGATRDVSWYQQHPGKAPKLVLYEVNSRPSDVSDRFSGSMSGN (SEQ ID NO: 424)

TASLTISGLQAEDEADYYCSSTTSRAPRVIFGGGTKLTVL

L-Variable (DNA):
CAGAGCGTCTTGACTCAGGCTGCCTCCGTGTCTGGGTCTCCTGGACAGTCGATCACCCTCTCCTG (SEQ ID NO: 425)

CACTGGAGCCACCAGGGACGTCTCCTGGTACCAACAACACCCAGGCAAGGCCCCCAAACTCGTCC

TTTATGAAGTCAATAGTCGC

CCCTCAGACGTTTCCGATCGCTTCTCTGGCTCCATGTCTGGCAACACGGCCTCCCTGACCATCTC

TGGACTCCAGGCTGAAGACGAGGCTGATTATTACTGCTCCTCAACCACAAGTCGCGCCCCTCGCG

TGATTTTCGGCGGAGGGACC

AAACTGACCGTCCTA

H-Variable (AA):
EVQLLESGGGLVQPGGSLRLSCAASGFTFSRYRMVWVRQAPGKGLEWVSWIYPSGGWTSYADSVK (SEQ ID NO: 426)

GRFTISRDNSKNTLYLQMNSLRAEDTAVYYCARSNYYDSAATLDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 427)

CGCTGCTTCCGGATTCACTTTCTCTCGTTACCGTATGGTTTGGGTTCGCCAAGCTCCTGGTAAAG

GTTTGGAGTGGGTTTCTTGG

ATCTATCCTTCTGGTGGCTGGACTTCTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGGTCAAAT

TACTATGATAGTGCTGCGACTCTTGATATCTGGGGCCAAGGGACAATGGTCACCGTCTCAAGC 67. 806C-M0054-C03
L-Variable (AA):
QDIQMTQSPSSLSASVGDRVTITCRASQTISSYLNWYQQKPGKAPKLLISAASTLQSGVPSRFSG (SEQ ID NO: 428)

SGSGTDFTLTISSLQPEDFATYYCQQSYSTPSFGQGTKVEIK

L-Variable (DNA):
CAAGACATCCAGATGACCCAGTCTCCATCCTCCCTGTCTGCATCTGTAGGAGACAGAGTCACCAT (SEQ ID NO: 429)

CACTTGCCGGGCAAGTCAGACCATTAGCAGCTATTTAAATTGGTATCAGCAGAAACCAGGGAAAG

CCCCTAAGCTCCTGATCTCT

```
GCTGCATCCACTTTGCAAAGTGGGGTCCCATCAAGGTTCAGTGGCAGTGGATCTGGGACAGATTT

CACTCTCACCATCAGCAGTCTGCAACCTGAAGATTTTGCAACTTACTACTGTCAACAGAGTTACA

GTACCCCCTCGTTCGGCCAA

GGGACCAAGGTGGAAATCAAA

H-Variable (AA):
EVQLLESGGGLVQPGGSLRLSCAASGFTFSHYQMLWVRQAPGKGLEWVSSIYPSGGWTYYADSVK    (SEQ ID NO: 430)

GRFTISRDNSKNTLYLQMNSLRAEDTAVYYCARVGYSSGWYALTSKTFDYWGQGTLVTVSS

H-Variable (DNA):
GAAGTTCAATTGTTAGAGTCTGGTGGCGGTCTTGTTCAGCCTGGTGGTTCTTTACGTCTTTCTTG    (SEQ ID NO: 431)

CGCTGCTTCCGGATTCACTTTCTCTCATTACCAGATGCTTTGGGTTCGCCAAGCTCCTGGTAAAG

GTTTGGAGTGGGTTTCTTCT

ATCTATCCTTCTGGTGGCTGGACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGTGGGG

TATAGCAGTGGCTGGTACGCGTTGACTTCAAAGACTTTTGACTACTGGGGCCAGGGAACCCTGGT

CACCGTCTCAAGC 68. 806C-M0054-C07
L-Variable (AA):
QDIQMTQSPATLSLSPGDRAILSCRASHNIDNFLAWYQQKPGQAPRLLIYDASHRATGIPPRFSG    (SEQ ID NO: 432)

SGSGTDFTLTISSLEPEDFAVYFCQQRTNWLFGGGTKVEIK

L-Variable (DNA):
CAAGACATCCAGATGACCCAGTCTCCAGCCACCCTGTCTTTGTCTCCGGGGGATCGAGCCATCCT    (SEQ ID NO: 433)

CTCCTGTAGGGCCAGTCACAATATTGACAACTTCTTAGCCTGGTATCAACAGAAACCTGGCCAGG

CTCCCAGGCTCCTCATCTAT

GATGCATCTCATAGGGCCACTGGCATCCCCCCCCGGTTCAGTGGCAGTGGGTCTGGGACAGACTT

CACTCTCACCATCAGCAGCCTAGAACCTGAAGATTTTGCTGTGTATTTCTGTCAACAACGGACCA

ACTGGCTTTTCGGCGGAGGG

ACCAAGGTGGAGATCAAA

H-Variable (AA):
EVQLLESGGGLVQPGGSLRLSCAASGFTFSRYPMNWVRQAPGKGLEWVSRIWPSGGSTVYADSVK    (SEQ ID NO: 434)

GRFTISRDNSKNTLYLQMNSLRAEDTAVYYCARDSSRYFDVWGRGTLVTVSS

H-Variable (DNA):
GAAGTTCAATTGTTAGAGTCTGGTGGCGGTCTTGTTCAGCCTGGTGGTTCTTTACGTCTTTCTTG    (SEQ ID NO: 435)

CGCTGCTTCCGGATTCACTTTCTCTCGTTACCCTATGAATTGGGTTCGCCAAGCTCCTGGTAAAG

GTTTGGAGTGGGTTTCTCGT

ATCTGGCCTTCTGGTGGCTCTACTGTTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGATTCT

TCTCGATACTTCGATGTCTGGGGCCGTGGCACCCTGGTCACCGTCTCAAGC 69. 806C-M0054-E04
L-Variable (AA):
QDIQMTQSPATLSVSPGERATLSCRASQSISSNLAWYQQKPGQAPRLLIYGTSTRATGIPARFSG    (SEQ ID NO: 436)

SGSGTEFTLTISSLQSEDFVVYYCQQYKDWPLTFGGGTTVEIK
```

```
L-Variable (DNA):
CAAGACATCCAGATGACCCAGTCTCCAGCCACCCTGTCTGTGTCTCCAGGGGAAAGAGCCACCCT   (SEQ ID NO: 437)

CTCCTGCAGGGCCAGTCAGAGTATTAGCAGTAATTTAGCCTGGTACCAACAAAAACCTGGCCAGG

CTCCCAGGCTCCTCATCTAT

GGTACATCCACCAGGGCCACTGGTATCCCAGCCAGGTTCAGTGGCAGTGGGTCTGGGACCGAGTT

CACTCTCACCATCAGCAGCCTGCAGTCTGAAGATTTTGTAGTTTATTACTGTCAGCAGTATAAAG

ACTGGCCTCTCACTTTCGGC

GGAGGGACCACGGTGGAGATCAAG

H-Variable (AA):
EVQLLESGGGLVQPGGSLRLSCAASGFTFSNYKMHWVRQAPGKGLEWVSVIYPSGGVTEYADSVK   (SEQ ID NO: 438)

GRFTISRDNSKNTLYLQMNSLRAEDTAVYYCARDQYSGHDYWGQGTLVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 439)

CGCTGCTTCCGGATTCACTTTCTCTAATTACAAGATGCATTGGGTTCGCCAAGCTCCTGGTAAAG

GTTTGGAGTGGGTTTCTGTT

ATCTATCCTTCTGGTGGCGTTACTGAGTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGATCAA

TACAGTGGCCATGACTACTGGGGCCAGGGAACCCTGGTCACCGTCTCAAGC 70. 806C-M0054-G01
L-Variable (AA):
QDIQMTQSPGTLSLSPGERATLSCRASQSVSSYLAWYQQKPGQAPRLLIYDASNRATGIPARFSG   (SEQ ID NO: 440)

SGSGTDFTLTISSLEPEDFAVYYCQQRYSWPLTFGGGTKVEIK

L-Variable (DNA):
CAAGACATCCAGATGACCCAGTCTCCAGGCACCCTGTCTTTGTCTCCAGGGGAAAGAGCCACCCT   (SEQ ID NO: 441)

CTCCTGCAGGGCCAGTCAGAGTGTTAGCAGCTACTTAGCCTGGTACCAACAGAAACCTGGCCAGG

CTCCCAGGCTCCTCATCTAT

GATGCATCCAACAGGGCCACTGGCATCCCAGCCAGGTTCAGTGGCAGTGGGTCTGGGACAGACTT

CACTCTCACCATCAGCAGCCTAGAGCCTGAAGATTTTGCAGTTTATTACTGTCAGCAGCGTTACA

GCTGGCCTCTCACTTTCGGC

GGAGGGACCAAGGTGGAGATCAAG

H-Variable (AA):
EVQLLESGGGLVQPGGSLRLSCAASGFTFSEYQMIWVRQAPGKGLEWVSYIVPSGGFTAYADSVK   (SEQ ID NO: 442)

GRFTISRDNSKNTLYLQMNSLRAEDTAVYYCARVNYYGMDVWGQGTTVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 443)

CGCTGCTTCCGGATTCACTTTCTCTGAGTACCAGATGATTTGGGTTCGCCAAGCTCCTGGTAAAG

GTTTGGAGTGGGTTTCTTATATCGTTCCTTCTGGTGGCTTTACTGCTTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCGAGAGTGAACTACTACGGTATGGACGTCTGGGGCC

AAGGGACCACGGTCACCGTCTCAAGC 71. 806C-M0054-G05
L-Variable (AA):
QSALTQPASVSGSPGQSISISCTGTNTDVGGYNYVSWYQQHPGKAPKLMIYDVSNRPSGVSNRFS   (SEQ ID NO: 444)

GSKSGNTASLTISGLQAEDEADYYCSSYTSSSTWVFGGGTKLTVL
```

L-Variable (DNA):
CAGAGCGCTTTGACTCAGCCTGCCTCCGTGTCTGGGTCTCCTGGACAGTCGATCAGCATCTCCTG (SEQ ID NO: 445)

CACTGGAACCAACACTGACGTTGGTGGTTATAACTATGTCTCCTGGTACCAACAACACCCAGGCA

AAGCCCCCAAACTCATGATTTATGATGTCAGTAATCGGCCCTCAGGGGTTTCTAATCGCTTCTCT

GGCTCCAAGTCTGGCAACACGGCCTCCCTGACCATCTCTGGGCTCCAGGCTGAGGACGAGGCTGA

TTATTACTGCAGCTCATATACAAGTAGTAGCACTTGGGTGTTCGGCGGAGGGACCAAGCTGACCG

TCCTA

H-Variable (AA):
EVQLLESGGGLVQPGGSLRLSCAASGFTFSAYLMEWVRQAPGKGLEWVSGIYPSGGKTYYADSVK (SEQ ID NO: 446)

GRFTISRDNSKNTLYLQMNSLRAEDTAVYYCARVNVISVAGTGYYYYGMDVWGQGTTVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 447)

CGCTGCTTCCGGATTCACTTTCTCTGCTTACCTTATGGAGTGGGTTCGCCAAGCTCCTGGTAAAG

GTTTGGAGTGGGTTTCTGGT

ATCTATCCTTCTGGTGGCAAGACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGTGAAC

GTTATATCAGTGGCTGGTACTGGCTACTACTACTACGGTATGGACGTCTGGGGCCAAGGGACCAC

GGTCACCGTCTCAAGC 72. 806C-M0054-H10
L-Variable (AA):
QDIQMTQSPATLSLSPGERATLSCRASQSVSIYLAWYQQKPGQAPRLLIYDASNRATDIPARFSG (SEQ ID NO: 448)

SGSGTDFTLTISSLEPEDFAVYYCQQRSSWPITFGLGTRLEIK

L-Variable (DNA):
CAAGACATCCAGATGACCCAGTCTCCAGCCACCCTGTCTTTGTCTCCAGGGGAAAGAGCCACCCT (SEQ ID NO: 449)

CTCCTGCAGGGCCAGTCAGAGTGTTAGCATCTACTTAGCCTGGTACCAACAGAAACCTGGTCAGG

CTCCCAGGCTCCTCATCTAT

GATGCATCCAACAGGGCCACTGACATCCCAGCCAGGTTCAGTGGCAGTGGGTCTGGGACAGACTT

CACTCTCACCATCAGCAGCCTAGAGCCTGAAGATTTTGCAGTTTATTACTGTCAGCAACGTAGCA

GCTGGCCGATCACCTTCGGC

CTTGGGACACGACTGGAGATTAAA

H-Variable (AA):
EVQLLESGGGLVQPGGSLRLSCAASGFTFSQYPMIWVRQAPGKGLEWVSVISPSGGHTSYADSVK (SEQ ID NO: 450)

GRFTISRDNSKNTLYLQMNSLRAEDTAVYYCARIQYYGGAFDIWGQGKMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 451)

CGCTGCTTCCGGATTCACTTTCTCTCAGTACCCTATGATTTGGGTTCGCCAAGCTCCTGGTAAAG

GTTTGGAGTGGGTTTCTGTT

ATCTCTCCTTCTGGTGGCCATACTTCTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAATCCAG

TACTACGGTGGGGCTTTTGATATCTGGGGCCAAGGGAAAATGGTCACCGTCTCAAGC

-continued 73. 806C-M0055-A09
L-Variable (AA):
QDIQMTQSPSSLSASVGDGVTITCRASQSINNHLNWYQQKPGKAPKVLIYAASSLQSGVPSRFSG (SEQ ID NO: 452)

SGSGTDFTLTISSLQPEDFATYYCQQSYSTPWTFGQGTKVEIK

L-Variable (DNA):
CAAGACATCCAGATGACCCAGTCTCCATCCTCCCTGTCTGCATCTGTAGGAGACGGAGTCACCAT (SEQ ID NO: 453)

CACTTGCCGGGCAAGTCAGAGCATTAACAACCATTTAAATTGGTATCAGCAGAAACCAGGGAAAG

CCCCTAAGGTCCTGATCTATGCTGCATCCAGTTTGCAAAGTGGGGTCCCATCAAGGTTCAGTGGC

AGTGGATCTGGGACAGATTTCACTCTCACCATCAGCAGTCTGCAACCTGAAGATTTTGCAACTTA

CTACTGTCAACAGAGTTACAGTACCCCGTGGACGTTCGGCCAAGGGACCAAGGTGGAAATCAAA

H-Variable (AA):
EVQLLESGGGLVQPGGSLRLSCAASGFTFSKYRMSWVRQAPGKGLEWVSGIYPSGGGTTYADSVK (SEQ ID NO: 454)

GRFTISRDNSKNTLYLQMNSLRAEDTAVYYCARPTYYYDSSGYYYSGPIDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 455)

CGCTGCTTCCGGATTCACTTTCTCTAAGTACCGTATGTCTTGGGTTCGCCAAGCTCCTGGTAAAG

GTTTGGAGTGGGTTTCTGGTATCTATCCTTCTGGTGGCGGTACTACTTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCGAGACCCACGTATTACTATGATAGTAGTGGTTATT

ACTACTCGGGGCCTATTGACTACTGGGGCCAGGGAACCCTGGTCACCGTCTCAAGC 74. 806C-M0055-B11
L-Variable (AA):
QYELTQPASVSGSPGQSITISCTGTNTDVGGYNLVSWYQQHPGKAPKLIIYEVSNRPSGVSNRFS (SEQ ID NO: 456)

GSKSGNTASLTISGLQAEDEVDYYCGSYTSSSTHVFGSGTKVTVL

L-Variable (DNA):
CAGTACGAATTGACTCAGCCTGCCTCCGTGTCTGGGTCTCCTGGACAGTCGATCACCATCTCCTG (SEQ ID NO: 457)

CACTGGAACCAACACTGACGTTGGTGGTTATAACCTTGTCTCCTGGTACCAACAGCACCCAGGCA

AAGCCCCCAAACTCATAATT

TATGAGGTCAGTAATCGGCCCTCAGGGGTTTCTAATCGCTTCTCTGGCTCCAAGTCTGGCAACAC

GGCCTCCCTGACCATCTCTGGGCTCCAGGCTGAGGACGAGGTTGATTATTATTGCGGCTCATATA

CAAGCAGCAGTACTCATGTC

TTCGGAAGTGGGACCAAGGTCACCGTCCTA

H-Variable (AA):
EVQLLESGGGLVQPGGSLRLSCAASGFTFSAYKMHWVRQAPGKGLEWVSVIYPSGGWTYYADSVK (SEQ ID NO: 458)

GRFTISRDNSKNTLYLQMNSLRAEDTAVYYCARGTAGWFDPWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 459)

CGCTGCTTCCGGATTCACTTTCTCTGCTTACAAGATGCATTGGGTTCGCCAAGCTCCTGGTAAAG

GTTTGGAGTGGGTTTCTGTT

ATCTATCCTTCTGGTGGCTGGACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCAAGAGGGACT

GCAGGGTGGTTCGACCCTTGGGGCCAGGGAACCCTGGTCACCGTCTCAAGC 75. 806C-M0055-B12
L-Variable (AA):
QSELTQPASVSGSPGQSITISCTGTSSDVGSYNLVSWYQQHPGKAPKLMIYEGSKRPSGVSNRFS    (SEQ ID NO: 460)

GSKSGNTASLTISGLQAEDEADYYCCSYAGSSTYVFGTGTKVTVL

L-Variable (DNA):
CAGAGCGAATTGACTCAGCCTGCCTCCGTGTCTGGGTCTCCTGGACAGTCGATCACCATCTCCTG    (SEQ ID NO: 461)

CACTGGAACCAGCAGTGATGTTGGGAGTTATAACCTTGTCTCCTGGTACCAACAGCACCCAGGCA

AAGCCCCCAAACTCATGATTTATGAGGGCAGTAAGCGGCCCTCAGGGGTTTCTAATCGCTTCTCT

GGCTCCAAGTCTGGCAACACGGCCTCCCTGACAATCTCTGGGCTCCAGGCTGAGGACGAGGCTGA

TTATTACTGCTGCTCATATGCAGGTAGTAGCACTTATGTCTTCGGAACTGGGACCAAGGTCACCG

TCCTA

H-Variable (AA):
EVQLLESGGGLVQPGGSLRLSCAASGFTFSNYKMTWVRQAPGKGLEWVSSIYPSGGWTYYADSVK    (SEQ ID NO: 462)

GRFTISRDNSKNTLYLQMNSLRAEDTAMYYCARQEDGGYGTWGQGTLVTVSS

H-Variable (DNA):
GAAGTTCAATTGTTAGAGTCTGGTGGCGGTCTTGTTCAGCCTGGTGGTTCTTTACGTCTTTCTTG    (SEQ ID NO: 463)

CGCTGCTTCCGGATTCACTTTCTCTAATTACAAGATGACTTGGGTTCGCCAAGCTCCTGGTAAAG

GTTTGGAGTGGGTTTCTTCT

ATCTATCCTTCTGGTGGCTGGACTTATTATGCTGACTCCGTTAAAGGTCGCTTCACTATCTCTAG

AGACAACTCTAAGAATACTCTCTACTTGCAGATGAACAGCTTAAGGGCTGAGGACACCGCCATGT

ATTACTGTGCGAGACAGGAG

GATGGTGGCTACGGGACTTGGGGCCAGGGAACCCTGGTCACCGTCTCAAGC 76. 806C-M0055-C05
L-Variable (AA):
QSVLTQDPAVSVALGQTVRITCQGDSLRSYYATWYQQKPGQAPVLVIYGENNRPSGIPDRFSGSS    (SEQ ID NO: 464)

SGNTGSLTITGAQAEDEADYYCNSRDTSGSHLLFGGGTKLTVL

L-Variable (DNA):
CAGAGCGTCTTGACTCAGGACCCTGCTGTGTCTGTGGCCTTGGGACAGACAGTCAGGATCACATG    (SEQ ID NO: 465)

CCAAGGAGACAGCCTCAGAAGCTATTATGCAACCTGGTACCAACAGAAGCCAGGACAGGCCCCTG

TACTTGTCATCTATGGTGAA

AACAACCGGCCCTCAGGGATCCCAGACCGATTCTCTGGCTCCAGTTCAGGAAACACAGGTTCCTT

GACCATCACTGGGGCTCAGGCGGAAGATGAGGCTGACTATTACTGTAACTCCCGGGACACCAGTG

GTAGTCATCTATTATTCGGC

GGAGGGACCAAGCTGACCGTCCTG

H-Variable (AA):
EVQLLESGGGLVQPGGSLRLSCAASGFTFSQYKMLWVRQAPGKGLEWVSSIYPSGGWTSYADSVK    (SEQ ID NO: 466)

GRFTISRDNSKNTLYLQMNSLRAEDTAVYYCARASYYDSGGYYRENFQFWGQGTLVTVSS

H-Variable (DNA):
GAAGTTCAATTGTTAGAGTCTGGTGGCGGTCTTGTTCAGCCTGGTGGTTCTTTACGTCTTTCTTG    (SEQ ID NO: 467)

CGCTGCTTCCGGATTCACTTTCTCTCAGTACAAGATGCTTTGGGTTCGCCAAGCTCCTGGTAAAG

GTTTGGAGTGGGTTTCTTCTATCTATCCTTCTGGTGGCTGGACTTCTTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCGAGAGCCTCTTACTATGATAGTGGAGGTTATTACC

GAGAAAACTTCCAGTTTTGGGGCCAGGGCACCCTGGTCACCGTCTCAAGC 77. 806C-M0055-C07
L-Variable (AA):
QDIQMTQSPSSLSASVGDRVTIICRASQSISIYLNWYQQKPGKAPKVLIYDASSLQSGVPSRFSG (SEQ ID NO: 468)

SGSGTDFSLTITSLQPEDFATYYCQQSYSTPPMYTFGQGTKLEIK

L-Variable (DNA):
CAAGACATCCAGATGACCCAGTCTCCATCCTCCCTGTCTGCATCTGTAGGAGACAGAGTCACCAT (SEQ ID NO: 469)

CATTTGCCGGGCAAGTCAGAGCATCAGCATCTATTTAAATTGGTATCAGCAGAAACCAGGGAAAG

CCCCTAAGGTCCTGATATATGATGCATCCAGTTTGCAAAGTGGGGTCCCATCAAGGTTCAGTGGC

AGTGGATCTGGGACAGATTTCAGTCTCACCATCACCAGTCTGCAACCTGAAGATTTTGCAACTTA

CTACTGTCAACAGAGTTACAGTACCCCTCCCATGTACACTTTTGGCCAGGGGACCAAGCTGGAGA

TCAAA

H-Variable (AA):
EVQLLESGGGLVQPGGSLRLSCAASGFTFSSYKMHWVRQAPGKGLEWVSVIYPSGGATYYADSVK (SEQ ID NO: 470)

GRFTISRDNSKNTLYLQMNSLRAEDTATYYCAKGLDFWSGPDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 471)

CGCTGCTTCCGGATTCACTTTCTCTTCTTACAAGATGCATTGGGTTCGCCAAGCTCCTGGTAAAG

GTTTGGAGTGGGTTTCTGTTATCTATCCTTCTGGTGGCGCTACTTATTATGCTGACTCTGTTAAA

GGTCGCTTCACTATCTCTAGAGACAACTCTAAGAATACTCTCTACTTGCAGATGAACAGCTTAAG

GGCTGAGGACACAGCCACATATTACTGTGCAAAAGGGCTCGATTTTTGGAGTGGCCCGGACTACT

GGGGCCAGGGCACCCTGGTCACCGTCTCAAGC 78. 806C-M0055-D03
L-Variable (AA):
QDIQMTQSPSSLSASVGDRVTITCWASQDIRTSLAWYQQKPGKPPKLLIFAASTLQGGVPSRFSG (SEQ ID NO: 472)

SGSGTEFTLTISGLQPEDFATYYCQHLNGYPLTFGDGTKVEIR

L-Variable (DNA):
CAAGACATCCAGATGACCCAGTCTCCATCCTCCCTGTCTGCATCTGTAGGAGACAGAGTCACCAT (SEQ ID NO: 473)

CACTTGCTGGGCCAGTCAGGATATTCGCACTTCTTTAGCCTGGTATCAGCAGAAACCAGGGAAAC

CCCCTAAACTCCTCATCTTTGCTGCGTCTACTTTGCAAGGTGGGGTCCCATCAAGGTTCAGCGGC

AGTGGATCTGGGACAGAATTCACTCTCACAATCTCCGGCCTGCAGCCTGAGGATTTTGCGACTTA

TTACTGTCAGCACCTTAATGGTTACCCGCTCACTTTCGGC

GATGGGACCAAGGTGGAGATCAGA

H-Variable (AA):
EVQLLESGGGLVQPGGSLRLSCAASGFTFSNYVMQWVRQAPGKGLEWVSVIYPSGGMTNYADSVK (SEQ ID NO: 474)

GRFTISRDNSKNTLYLQMNSLRAEDTATYYCARIRGDTRAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 475)

CGCTGCTTCCGGATTCACTTTCTCTAATTACGTTATGCAGTGGGTTCGCCAAGCTCCTGGTAAAG

GTTTGGAGTGGGTTTCTGTT

ATCTATCCTTCTGGTGGCATGACTAATTATGCTGACTCCGTTAAAGGTCGCTTCACTATCTCTAG

AGACAACTCTAAGAATACTCTCTACTTGCAGATGAACAGCTTAAGGGCTGAGGACACAGCCACGT

ATTACTGTGCACGGATACGC

GGTGACACCAGGGCTTTTGATATCTGGGGCCAAGGGACAATGGTCACCGTCTCAAGC

-continued 79. 806C-M0055-D06
L-Variable (AA):
QDIQMTQSPGTLSLSPGERATLSCRASQSVSSSYLAWYQQKPGQAPRLLIYGASSRATGIPDRFS (SEQ ID NO: 476)

GSGSGTDFTLTISRLEPEDLAVYYCQLFGSSPRITFGQGTRLEIK

L-Variable (DNA):
CAAGACATCCAGATGACCCAGTCTCCAGGCACCCTGTCTTTGTCTCCAGGGGAAAGAGCCACCCT (SEQ ID NO: 477)

CTCCTGCAGGGCCAGTCAGAGTGTTAGCAGCAGCTACTTAGCCTGGTACCAGCAGAAACCTGGCC

AGGCTCCCAGGCTCCTCATC

TATGGTGCATCCAGCAGGGCCACTGGCATCCCAGACAGGTTCAGTGGCAGTGGGTCTGGGACAGA

CTTCACTCTCACCATCAGCAGACTGGAGCCTGAAGATTTGGCAGTATATTACTGTCAGCTGTTTG

GAAGCTCTCCTCGGATCACC

TTCGGCCAGGGGACGCGGCTGGAAATTAAA

H-Variable (AA):
EVQLLESGGGLVQPGGSLRLSCAASGFTFSKYKMWWVRQAPGKGLEWVSVIYPSGGATYYADSVK (SEQ ID NO: 478)

GRFTISRDNSKNTLYLQMNSLRAEDTAVYYCARSSLGCSSTSCYDAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 479)

CGCTGCTTCCGGATTCACTTTCTCTAAGTACAAGATGTGGTGGGTTCGCCAAGCTCCTGGTAAAG

GTTTGGAGTGGGTTTCTGTT

ATCTATCCTTCTGGTGGCGCTACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGGTCTTCT

CTAGGGTGTAGTAGTACCAGCTGCTATGATGCTTTTGATATCTGGGGCCAAGGGACAATGGTCAC

CGTCTCAAGC 80. 806C-M0055-D12
L-Variable (AA):
QDIQMTQSPSSLSASVGDRVTITCRASQGISNYLAWYQQKPGKVPKLLIYAASTLQSGVPSRFSG (SEQ ID NO: 480)

SGSGTDFTLTISSLQPEDVATYYCQKYNSAPWTFGQGTKVEIK

L-Variable (DNA):
CAAGACATCCAGATGACCCAGTCTCCATCCTCCCTGTCTGCATCTGTAGGAGACAGAGTCACCAT (SEQ ID NO: 481)

CACTTGCCGGGCGAGTCAGGGCATTAGCAATTATTTAGCCTGGTATCAGCAGAAACCAGGGAAAG

TTCCTAAGCTCCTGATCTAT

GCTGCATCCACTTTGCAATCAGGGGTCCCATCTCGGTTCAGTGGCAGTGGATCTGGGACAGATTT

CACTCTCACCATCAGCAGCCTGCAGCCTGAAGATGTTGCAACTTATTACTGTCAAAAGTATAACA

GTGCCCCCTGGACGTTCGGC

CAAGGGACCAAGGTGGAAATCAAA

H-Variable (AA):
EVQLLESGGGLVQPGGSLRLSCAASGFTFSTYGMWWVRQAPGKGLEWVSSISSGGSTVYADSVKG (SEQ ID NO: 482)

RFTISRDNSKNTLYLQMNSLRAEDTAVYYCARDLTTVTGNYFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 483)

CGCTGCTTCCGGATTCACTTTCTCTACTTACGGTATGTGGTGGGTTCGCCAAGCTCCTGGTAAAG

GTTTGGAGTGGGTTTCTTCT

ATCTCTTCTGGTGGCTCTACTGTTTATGCTGACTCCGTTAAAGGTCGCTTCACTATCTCTAGAGA

CAACTCTAAGAATACTCTCTACTTGCAGATGAACAGCTTAAGGGCTGAGGACACGGCCGTGTATT

ACTGTGCGAGAGATCTGACT

ACGGTGACGGGGAACTACTTTGACTACTGGGGCCAGGGAACCCTGGTCACCGTCTCAAGC 81. 806C-M0055-E04
L-Variable (AA):
QDIQMTQSPGTLSLSPGERATLSCRASQSVSSSQLAWYQHKRGQPPRLLIYGASSRATGIPDRFS  (SEQ ID NO: 484)

GSGSGTDYILTISRLEPEDFAVYYCQHFGSSPPATFGQGTKVEIK

L-Variable (DNA):
CAAGACATCCAGATGACCCAGTCTCCAGGCACCCTATCTTTGTCTCCAGGGGAAAGAGCCACCCT  (SEQ ID NO: 485)

CTCCTGCAGGGCCAGTCAGAGTGTTTCCAGCAGCCAGTTAGCCTGGTACCAGCATAAACGTGGCC

AGCCTCCCAGGCTCCTCATC

TATGGTGCATCCAGCAGGGCCACTGGCATCCCAGACAGGTTCAGTGGCAGTGGGTCTGGGACAGA

CTACATTCTCACCATCAGCAGACTGGAGCCTGAAGATTTTGCAGTGTATTACTGTCAGCATTTTG

GTAGTTCACCTCCGGCGACG

TTCGGCCAAGGGACCAAGGTGGAAATCAAA

H-Variable (AA):
EVQLLESGGGLVQPGGSLRLSCAASGFTFSSYKMVWVRQAPGKGLEWVSSIYPSGGVTIYADSVK  (SEQ ID NO: 486)

GRFTISRDNSKNTLYLQMNSLRAEDTAVYYCARDGSSSGWYNPRRAFDYWGQGTLVTVSS

H-Variable (DNA):
GAAGTTCAATTGTTAGAGTCTGGTGGCGGTCTTGTTCAGCCTGGTGGTTCTTTACGTCTTTCTTG  (SEQ ID NO: 487)

CGCTGCTTCCGGATTCACTTTCTCTTCTTACAAGATGGTTTGGGTTCGCCAAGCTCCTGGTAAAG

GTTTGGAGTGGGTTTCTTCT

ATCTATCCTTCTGGTGGCGTTACTATTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGATGGA

AGTAGCAGTGGCTGGTACAATCCCCGTAGGGCCTTTGACTACTGGGGCCAGGGAACCCTGGTCAC

CGTCTCAAGC 82. 806C-M0055-E06
L-Variable (AA):
QYELTQPPSLSVSPGQTVKITCSAEKLSEKYVAWYQQRPGQSPVMVIYQDSRRPSGIPERFSGSN  (SEQ ID NO: 488)

SGNTATLTISGTQPMDEADYYCQAWFSDSLPFGSGTKVTVL

L-Variable (DNA):
CAGTACGAATTGACTCAGCCACCCTCTCTGTCCGTGTCCCCAGGACAGACAGTCAAGATCACCTG  (SEQ ID NO: 489)

CTCTGCAGAGAAGTTGAGTGAGAAATATGTTGCTTGGTATCAACAGAGGCCGGGCCAGTCCCCTG

TCATGGTCATCTATCAAGAT

AGTAGGCGGCCCTCAGGGATCCCTGAGCGATTCTCTGGCTCCAACTCTGGGAACACAGCCACTCT

GACCATCAGCGGGACCCAGCCCATGGATGAGGCTGACTACTATTGTCAGGCGTGGTTTAGCGACA

GTCTCCCCTTTGGAAGTGGG

ACCAAGGTCACCGTCCTA

H-Variable (AA):
EVQLLESGGGLVQPGGSLRLSCAASGFTFSKYKMIWVRQAPGKGLEWVSSIYPSGGHTIYADSVK  (SEQ ID NO: 490)

GRFTISRDNSKNTLYLQMNSLRAEDTAMYYCAREGGGATSFDYWGQGTLVTVSS

H-Variable (DNA):
GAAGTTCAATTGTTAGAGTCTGGTGGCGGTCTTGTTCAGCCTGGTGGTTCTTTACGTCTTTCTTG  (SEQ ID NO: 491)

CGCTGCTTCCGGATTCACTTTCTCTAAGTACAAGATGATCTGGGTTCGCCAAGCTCCTGGTAAAG

GTTTGGAGTGGGTTTCTTCT

-continued

ATCTATCCTTCTGGTGGCCATACTATTTATGCTGACTCCGTTAAAGGTCGCTTCACTATCTCTAG

AGACAACTCTAAGAATACTCTCTACTTGCAGATGAACAGCTTAAGGGCTGAGGACACCGCCATGT

ATTACTGTGCGAGAGAGGGC

GGGGGAGCTACCTCCTTTGACTACTGGGGCCAGGGAACCCTGGTCACCGTCTCAAGC 83. 806C-M0055-E10
L-Variable (AA):
QDIQMTQSPATLSLSPGERATLSCRASQSVRTYLGWYQQKHGQAPRLLIYDASNRATGIPARFSG (SEQ ID NO: 492)

SGSGTDFTLTISSLEPEDFAVYYCQQRSNWPLTFGGGTKVEIK

L-Variable (DNA):
CAAGACATCCAGATGACCCAGTCTCCAGCCACCCTGTCTTTGTCTCCAGGGGAAAGAGCCACCCT (SEQ ID NO: 493)

CTCCTGCAGGGCCAGTCAGAGTGTTAGGACCTATTTAGGCTGGTACCAACAGAAACATGGCCAGG

CTCCCAGGCTCCTCATCTATGATGCATCCAACAGGGCCACTGGCATCCCAGCCAGGTTCAGTGGC

AGTGGGTCTGGGACAGACTTCACTCTCACCATCAGCAGCCTAGAGCCTGAAGATTTTGCAGTTTA

TTACTGTCAGCAGCGTAGCAACTGGCCGCTCACTTTCGGCGGAGGGACCAAGGTGGAGATCAAA

H-Variable (AA):
EVQLLESGGGLVQPGGSLRLSCAASGFTFSAYPMFWVRQAPGKGLEWVSVISPSGGQTSYADSVK (SEQ ID NO: 494)

GRFTISRDNSKNTLYLQMNSLRAEDTAVYYCAKSFSGLAALDFWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 495)

CGCTGCTTCCGGATTCACTTTCTCTGCTTACCCTATGTTTTGGGTTCGCCAAGCTCCTGGTAAAG

GTTTGGAGTGGGTTTCTGTT

ATCTCTCCTTCTGGTGGCCAGACTTCTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAAATCATTC

TCAGGCTTAGCAGCTCTTGACTTCTGGGGCCAGGGAACCCTGGTCACCGTCTCAAGC 84. 806C-M0055-E12
L-Variable (AA):
QDIQMTQSPGTLSLSPGERATLSCRASQTVSSGSLAWYQQKPGLAPRLLIYGASRRGTGIPDRFS (SEQ ID NO: 496)

GSGSGTDFTLTISRLEPEDFAVYYCQQYGSTLPLTFGGGTKVEIK

L-Variable (DNA):
CAAGACATCCAGATGACCCAGTCTCCAGGCACCCTGTCTTTGTCTCCAGGGGAAAGAGCCACCCT (SEQ ID NO: 497)

CTCCTGCAGGGCCAGTCAGACAGTGAGCAGCGGCTCCTTAGCCTGGTACCAGCAGAAACCTGGCC

TGGCTCCCAGGCTCCTCATC

TATGGTGCATCCCGTAGGGGCACTGGCATCCCAGACAGGTTCAGTGGCAGTGGGTCTGGGACAGA

CTTCACTCTCACCATCAGCAGACTGGAGCCTGAAGATTTTGCAGTGTACTACTGTCAGCAGTATG

GTAGTACACTCCCGCTCACT

TTCGGCGGAGGGACCAAGGTCGAGATCAAA

H-Variable (AA):
EVQLLESGGGLVQPGGSLRLSCAASGFTFSQYTMYWVRQAPGKGLEWVSSIYPSGGWTNYADSVK (SEQ ID NO: 498)

GRFTISRDNSKNTLYLQMNSLRAEDMAVYYCARGRGGSKAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 499)

CGCTGCTTCCGGATTCACTTTCTCTCAGTACACTATGTATTGGGTTCGCCAAGCTCCTGGTAAAG

GTTTGGAGTGGGTTTCTTCT

ATCTATCCTTCTGGTGGCTGGACTAATTATGCTGACTCCGTTAAAGGTCGCTTCACTATCTCTAG

```
AGACAACTCTAAGAATACTCTCTACTTGCAGATGAACAGCTTAAGGGCTGAGGACATGGCTGTGT

ATTACTGTGCGAGAGGCCGT

GGTGGTAGCAAAGCTTTTGATATCTGGGGCCAAGGGACAATGGTCACCGTCTCAAGC
```

85. 806C-M0055-F10
```
L-Variable (AA):
QSELTQPASVSGSPGQSITISCTGTTSDVGGYNYVSWYQQDPGKVPKLIIYEVYNRPSGVSNRFS   (SEQ ID NO: 500)

GSKSGNTASLTISGLRAEDEADYYCSSKTSSVTYVFGTGTKVTVL

L-Variable (DNA):
CAGAGCGAATTGACTCAGCCTGCCTCCGTGTCTGGGTCTCCTGGACAGTCGATCACCATCTCCTG   (SEQ ID NO: 501)

CACTGGAACCACCAGTGACGTTGGTGGTTATAACTATGTCTCCTGGTATCAACAGGACCCAGGCA

AAGTCCCCAAACTCATAATT

TATGAGGTCTATAATCGGCCCTCAGGGGTTTCAAATCGCTTCTCTGGCTCCAAGTCTGGCAACAC

GGCCTCCCTGACCATCTCTGGGCTCCGGGCTGAGGACGAGGCTGATTATTACTGCAGCTCAAAAA

CAAGCAGCGTCACTTATGTC

TTTGGAACTGGGACCAAGGTCACCGTCCTA

H-Variable (AA):
EVQLLESGGGLVQPGGSLRLSCAASGFTFSAYVMSWVRQAPGKGLEWVSRIYPSGGGTRYADSVK   (SEQ ID NO: 502)

GRFTISRDNSKNTLYLQMNSLRAEDTAVYYCAKEAGGSYFLDYWGQGTLVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 503)

CGCTGCTTCCGGATTCACTTTCTCTGCTTACGTTATGTCTTGGGTTCGCCAAGCTCCTGGTAAAG

GTTTGGAGTGGGTTTCTCGT

ATCTATCCTTCTGGTGGCGGTACTCGTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAAAGAGGCG

GGTGGGAGCTACTTCCTTGACTACTGGGGCCAGGGAACCCTGGTCACCGTCTCAAGC
```

86. 806C-M0055-G02
```
L-Variable (AA):
QSELTQPRSVSGSLGQSVTISCTGTTSDVGRYNFVSWYQQYPGRAPKLIIHDVTRRPSGVSDRFS   (SEQ ID NO: 504)

GSKSGNTASLTISGLQAEDEADYYCCSYAGSFYVFGSGTQVTVL

L-Variable (DNA):
CAGAGCGAATTGACTCAGCCTCGCTCAGTGTCCGGGTCTCTTGGACAGTCAGTCACCATCTCCTG   (SEQ ID NO: 505)

CACTGGAACCACCAGTGATGTTGGTCGTTATAACTTTGTCTCCTGGTACCAACAGTATCCAGGCA

GAGCCCCCAAACTCATCATT

CATGATGTCACTCGGCGGCCCTCCGGGGTATCTGATCGCTTCTCTGGCTCCAAGTCCGGCAACAC

GGCCTCCCTGACCATCTCTGGTCTCCAGGCTGAGGATGAGGCTGATTATTACTGCTGCTCATATG

CAGGCAGCTTTTATGTCTTC

GGATCTGGGACCCAGGTCACCGTCTTG

H-Variable (AA):
EVQLLESGGGLVQPGGSLRLSCAASGFTFSSYKMIWVRQAPGKGLEWVSGIYPSGGATGYADSVK   (SEQ ID NO: 506)

GRFTISRDNSKNTLYLQMNSLRAEDTATYYCARDGGDIVVPDYWGQGTLVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 507)

CGCTGCTTCCGGATTCACTTTCTCTTCTTACAAGATGATTTGGGTTCGCCAAGCTCCTGGTAAAG

GTTTGGAGTGGGTTTCTGGT
```

ATCTATCCTTCTGGTGGCGCTACTGGTTATGCTGACTCCGTTAAAGGTCGCTTCACTATCTCTAG

AGACAACTCTAAGAATACTCTCTACTTGCAGATGAACAGCTTAAGGGCTGAGGACACAGCCACGT

ATTACTGTGCGAGAGATGGG

GGGGATATTGTAGTGCCTGACTACTGGGGCCAGGGAACCCTGGTCACCGTCTCAAGC

```
  87. 806C-M0055-G03
L-Variable (AA):
QYELTQPPSASGTPGQRVTISCSGSSSNIGTNTVYWYQQLPGTAPKLLIYTNVQRPSGVPDRFSG   (SEQ ID NO: 508)
```

SKSGTSASLAISGLQSEDEADYYCQSYDGSLSSAVFGGGTQLTVL

L-Variable (DNA):
CAGTACGAATTGACTCAGCCACCCTCAGCGTCTGGGACCCCCGGGCAGAGGGTCACCATCTCTTG   (SEQ ID NO: 509)

TTCTGGAAGCAGCTCCAACATCGGAACTAATACTGTATACTGGTACCAGCAGCTCCCAGGAACGG

CCCCCAAACTCCTCATCTAT

ACTAATGTCCAGCGGCCCTCAGGGGTCCCTGACCGATTCTCTGGCTCCAAGTCTGGCACCTCAGC

CTCCCTGGCCATCAGTGGGCTCCAGTCTGAGGATGAGGCTGATTATTACTGCCAGTCCTATGACG

GCAGCCTGAGTTCTGCTGTG

TTCGGAGGAGGCACCCAGCTGACCGTCCTC

H-Variable (AA):
EVQLLESGGGLVQPGGSLRLSCAASGFTFSKYHMGWVRQAPGKGLEWVSSIYSSGGITQYADSVK   (SEQ ID NO: 510)

GRFTISRDNSKNTLYLQMNSLRAEDTAVYYCARGRVGGWSLFNWFDPWGQGTLVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 511)

CGCTGCTTCCGGATTCACTTTCTCTAAGTACCATATGGGTTGGGTTCGCCAAGCTCCTGGTAAAG

GTTTGGAGTGGGTTTCTTCT

ATCTATTCTTCTGGTGGCATTACTCAGTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCAAGAGGCCGA

GTCGGTGGCTGGTCCCTTTTTAACTGGTTCGACCCCTGGGGCCAGGGCACCCTGGTCACCGTCTC

AAGC

```
  88. 806C-M0055-H04
L-Variable (AA):
QDIQMTQSPGTLSLSPGERATLSCRASQSVSSYLAWYQQKPGQAPRLLIYDASNRATGIPARFSG   (SEQ ID NO: 512)
```

SGSGTDFTLTISSLEPEDFAVYYCQQRSNWPRTFGQGTKVEIK

L-Variable (DNA):
CAAGACATCCAGATGACCCAGTCTCCAGGCACCCTGTCTTTGTCTCCAGGGGAAAGAGCCACCCT   (SEQ ID NO: 513)

CTCCTGCAGGGCCAGTCAGAGTGTTAGCAGCTACTTAGCCTGGTACCAACAGAAACCTGGCCAGG

CTCCCAGGCTCCTCATCTAT

GATGCATCCAACAGGGCCACTGGCATCCCAGCCAGGTTCAGTGGCAGTGGGTCTGGGACAGACTT

CACTCTCACCATCAGCAGCCTAGAGCCTGAAGATTTTGCAGTTTATTACTGTCAGCAGCGTAGCA

ACTGGCCTCGGACGTTCGGC

CAAGGGACCAAGGTGGAAATCAAA

H-Variable (AA):
EVQLLESGGGLVQPGGSLRLSCAASGFTFSSYPMYWVRQAPGKGLEWVSRIVPSGGWTNYADSVK   (SEQ ID NO: 514)

GRFTISRDNSKNTLYLQMNSLRAEDTAVYYCARDKGDWYFDLWGRGTLVTVSS

-continued

H-Variable (DNA):
GAAGTTCAATTGTTAGAGTCTGGTGGCGGTCTTGTTCAGCCTGGTGGTTCTTTACGTCTTTCTTG (SEQ ID NO: 515)

CGCTGCTTCCGGATTCACTTTCTCTTCTTACCCTATGTATTGGGTTCGCCAAGCTCCTGGTAAAG

GTTTGGAGTGGGTTTCTCGT

ATCGTTCCTTCTGGTGGCTGGACTAACTATGCTGACTCCGTTAAAGGTCGCTTCACTATCTCTAG

AGACAACTCTAAGAATACTCTACTTGCAGATGAACAGCTTAAGGGCTGAGGACACGGCCGTGT

ATTACTGTGCGAGAGATAAG

GGGGACTGGTACTTCGATCTCTGGGGCCGTGGCACCCTGGTCACCGTCTCAAGC 89. 806C-M0056-A01
L-Variable (AA):
QDIQMTQSPATLSLSPGERATLSCRASQSVSRYLAWYQQKPGQAPRLLIYDTSNRATGIPARFSG (SEQ ID NO: 516)

SGSGTDFTLTISSLEPEDFAIYYCQQRSNWPPALTFGGGTKVEIK

L-Variable (DNA):
CAAGACATCCAGATGACCCAGTCTCCAGCCACCCTGTCTCTGTCTCCAGGGGAGAGAGCCACCCT (SEQ ID NO: 517)

CTCCTGCAGGGCCAGTCAGAGTGTTAGCAGGTACTTAGCCTGGTATCAACAAAAACCTGGCCAGG

CTCCCAGGCTCCTCATCTAT

GATACATCCAACAGGGCCACTGGCATCCCAGCCAGGTTCAGTGGCAGTGGGTCTGGGACAGACTT

CACTCTCACCATCAGCAGCCTAGAGCCTGAAGATTTTGCAATTTATTACTGTCAGCAGCGTAGCA

ACTGGCCTCCGGCGCTCACT

TTCGGCGGAGGGACCAAGGTGGAGATCAAA

H-Variable (AA):
EVQLLESGGGLVQPGGSLRLSCAASGFTFSRYAMGWVRQAPGKGLEWVSWIYPSGGITSYADSVK (SEQ ID NO: 518)

GRFTISRDNSKNTLYLQMNSLRAEDTAMYYCARITYFDTSVIDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 519)

CGCTGCTTCCGGATTCACTTTCTCTCGTTACGCTATGGGTTGGGTTCGCCAAGCTCCTGGTAAAG

GTTTGGAGTGGGTTTCTTGG

ATCTATCCTTCTGGTGGCATTACTTCTTATGCTGACTCCGTTAAAGGTCGCTTCACTATCTCTAG

AGACAACTCTAAGAATACTCTACTTGCAGATGAACAGCTTAAGGGCTGAGGACACCGCCATGT

ATTACTGTGCACGGATTACG

TATTTTGATACCAGCGTTATTGACTACTGGGGCCAGGGAACCCTGGTCACCGTCTCAAGC 90. 806C-M0056-A06
L-Variable (AA):
QSVLTQPASVSGSPGQSITISCTGTSSNVGNYNLVSWYQQHPGKAPKLMIYEDNKRPSGVSNRFS (SEQ ID NO: 520)

VSKSGNTASLTISGLQTEDEAEYYCCSYAGSGTWCFGRRGTRVTV

L-Variable (DNA):
CAGAGCGTCTTGACTCAGCCTGCCTCCGTGTCTGGGTCTCCTGGACAGTCGATCACCATCTCCTG (SEQ ID NO: 521)

CACTGGAACCAGCAGTAATGTTGGGAATTATAACCTTGTCTCCTGGTACCAGCAGCACCCAGGCA

AAGCCCCCAAACTCATGATT

TATGAGGACAATAAGCGGCCCTCAGGGGTTTCTAATCGCTTCTCTGTGTCCAAGTCTGGCAACAC

GGCCTCCCTGACAATCTCTGGGCTCCAGACTGAGGACGAGGCTGAATATTACTGCTGCTCATATG

CAGGTAGTGGCACTTGGTGT

TTCGGGCGGAGGGGAACCAGAGTGACCGTC

H-Variable (AA):
EVQLLESGGGLVQPGGSLRLSCAASGFTFSHYPMEWVRQAPGKGLEWVSRIVPSGGWTTYADSVK (SEQ ID NO: 522)

GRFTISRDNSKNTLYLQMNSLRAEDTAVYYCASRVVTTYLDYFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 523)

CGCTGCTTCCGGATTCACTTTCTCTCATTACCCTATGGAGTGGGTTCGCCAAGCTCCTGGTAAAG

GTTTGGAGTGGGTTTCTCGT

ATCGTTCCTTCTGGTGGCTGGACTACTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGTCGGGTG

GTAACTACGTACTTAGACTACTTTGACTACTGGGGCCAGGGAACCCTGGTCACCGTCTCAAGC 91. 806C-M0056-B08
H-Variable (AA):
EVQLLESGGGLVQPGGSLRLSCAASGFTFSVYVMSWVRQAPGKGLEWVSSIYPSGGGTYYADSVK (SEQ ID NO: 524)

GRFTISRDNSKNTLYLQMNSLRAEDTATYYCARRKAAAGYLDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 525)

CGCTGCTTCCGGATTCACTTTCTCTGTTTACGTTATGTCTTGGGTTCGCCAAGCTCCTGGTAAAG

GTTTGGAGTGGGTTTCTTCTATCTATCCTTCTGGTGGCGGTACTTATTATGCTGACTCCGTTAAA

GGTCGCTTCACTATCTCTAGAGACAACTCTAAGAATACTCTCTACTTGCAGATGAACAGCTTAAG

GGCTGAGGACACAGCCACATATTACTGTGCGAGACGAAAAGCAGCAGCAGGTTACCTTGACTACT

GGGGCCAGGGAACCCTGGTCACCGTCTCAAGC

L-Variable (AA):
QSALTQPASVSGSPGQSITISCTGTSSDIGAYKHVSWYQQHPGKAPKLMIYEVTNRPSGISNRFS (SEQ ID NO: 526)

GSKSGNTASLTISGLQAEDEADYYCSSYTSRNTWVFGGGTKLTVL

L-Variable (DNA):
CAGAGCGCTTTGACTCAGCCTGCCTCCGTGTCTGGGTCTCCTGGACAGTCGATCACCATTTCCTG (SEQ ID NO: 527)

CACTGGAACTAGCAGTGACATTGGTGCTTATAAACATGTCTCCTGGTATCAACAACACCCAGGCA

AAGCCCCCAAACTCATGATT

TATGAGGTCACTAATCGGCCCTCAGGGATTTCTAATCGTTTCTCTGGCTCCAAGTCTGGCAACAC

GGCCTCCCTGACCATCTCTGGGCTCCAGGCTGAGGACGAGGCTGATTATTACTGCAGTTCATATA

CAAGCCGTAACACTTGGGTA

TTTGGCGGAGGGACCAAGCTGACCGTCCTA 92. 806C-M0056-B09
L-Variable (AA):
QDIQMTQSPGTLSLSPGERATLSCRASQSVSSSYLAWYQQKPGQAPRLLIYDASSRATGIPDRFS (SEQ ID NO: 528)

GSGSGTDFTLTISRLEPEDFAVYYCQQYGRSPSFGPGTKVDIK

L-Variable (DNA):
CAAGACATCCAGATGACCCAGTCTCCAGGCACCCTGTCTTTGTCTCCAGGGGAAAGAGCCACCCT (SEQ ID NO: 529)

CTCCTGCAGGGCCAGTCAGAGTGTTAGCAGCAGCTACTTAGCCTGGTACCAGCAGAAACCTGGCC

AGGCTCCCAGGCTCCTCATC

TATGATGCATCCAGTAGGGCCACTGGCATCCCAGACAGGTTCAGTGGCAGTGGGTCTGGGACAGA

CTTCACTCTCACCATCAGCAGACTGGAGCCTGAAGATTTTGCAGTGTATTACTGTCAGCAGTATG

GTAGGTCACCCTCTTTCGGC

CCTGGGACCAAAGTGGATATCAAA

-continued

H-Variable (AA):
EVQLLESGGGLVQPGGSLRLSCAASGFTFSHYKMSWVRQAPGKGLEWVSSIYPSGGWTYYADSVK (SEQ ID NO: 530)

GRFTISRDNSKNTLYLQMNSLRAEDMAVYYCARDRPGAFDVWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 531)

CGCTGCTTCCGGATTCACTTTCTCTCATTACAAGATGTCTTGGGTTCGCCAAGCTCCTGGTAAAG

GTTTGGAGTGGGTTTCTTCT

ATCTATCCTTCTGGTGGCTGGACTTATTATGCTGACTCCGTTAAAGGTCGCTTCACTATCTCTAG

AGACAACTCTAAGAATACTCTCTACTTGCAGATGAACAGCTTAAGGGCTGAGGACATGGCTGTGT

ATTACTGTGCAAGAGATCGG

CCTGGAGCTTTTGATGTTTGGGGCCAAGGGACAATGGTCACCGTCTCAAGC 93. 806C-M0056-C03
L-Variable (AA):
QDIQMTQSPGTLSLSPGERATLSCRASQSVSSSYLAWYQQKPGQAPRLLIYGASSRATGIPDRFS (SEQ ID NO: 532)

GSGSGTDFTLTISRLEPDDSATYYCQQYNSYPITFGQGTRLEIK

L-Variable (DNA):
CAAGACATCCAGATGACCCAGTCTCCAGGCACCCTGTCTTTGTCTCCAGGGGAAAGAGCCACCCT (SEQ ID NO: 533)

CTCCTGCAGGGCCAGTCAGAGTGTTAGCAGCAGCTACTTAGCCTGGTACCAGCAGAAACCTGGCC

AGGCTCCCAGGCTCCTCATC

TATGGTGCATCCAGCAGGGCCACTGGCATCCCAGACAGGTTCAGTGGCAGTGGGTCTGGGACAGA

CTTCACTCTCACCATCAGCAGACTGGAGCCTGATGATTCTGCAACCTATTACTGCCAACAATATA

ATAGTTATCCGATCACCTTC

GGCCAAGGGACACGACTGGAGATTAAA

H-Variable (AA):
EVQLLESGGGLVQPGGSLRLSCAASGFTFSSYKMWWVRQAPGKGLEWVSVIYPSGGATYYADSVK (SEQ ID NO: 534)

GRFTISRDNSKNTLYLQMNSLRAEDTAVYYCARGIGAVGGFDSWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 535)

CGCTGCTTCCGGATTCACTTTCTCTTCTTACAAGATGTGGTGGGTTCGCCAAGCTCCTGGTAAAG

GTTTGGAGTGGGTTTCTGTT

ATCTATCCTTCTGGTGGCGCTACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGGGATC

GGAGCAGTGGGCGGGTTTGACTCCTGGGGCCAGGGAACCCTGGTCACCGTCTCAAGC 94. 806C-M0056-C04
L-Variable (AA):
QDIQMTQSPSSLSASVGDRVTIACRASHDISDNLNWYQQKPGRAPKVVISDAFNLEAGVPSRFSG (SEQ ID NO: 536)

SRSGTYFTFTINSLQPEDVATYYCQQFNNVPYTFGQGTKLEIK

L-Variable (DNA):
CAAGACATCCAGATGACCCAGTCTCCATCCTCCCTGTCTGCATCTGTAGGAGACAGAGTCACCAT (SEQ ID NO: 537)

CGCTTGCCGGGCGAGTCACGACATTAGTGACAATTTAAATTGGTATCAGCAAAAACCAGGGAGAG

CCCCTAAGGTCGTGATCTCCGATGCATTCAATTTGGAAGCAGGGGTCCCATCAAGGTTCAGTGGA

AGTAGATCTGGGACATATTTTACTTTCACCATCAACAGCCTGCAGCCTGAAGATGTTGCAACATA

TTACTGTCAACAATTTAATAATGTCCCGTACACTTTTGGCCAGGGGACCAAGCTGGAGATCAAA

```
H-Variable (AA):
EVQLLESGGGLVQPGGSLRLSCAASGFTFSHYIMAWVRQAPGKGLEWVSRIYPSGGKTYYADSVK    (SEQ ID NO: 538)

GRFTISRDNSKNTLYLQMNSLRAEDTAVYYCARQGGGGRAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 539)

CGCTGCTTCCGGATTCACTTTCTCTCATTACATTATGGCTTGGGTTCGCCAAGCTCCTGGTAAAG

GTTTGGAGTGGGTTTCTCGTATCTATCCTTCTGGTGGCAAGACTTATTATGCTGACTCCGTTAAA

GGTCGCTTCACTATCTCTAGAGACAACTCTAAGAATACTCTACTTGCAGATGAACAGCTTAAG

GGCTGAGGACACGGCCGTGTATTACTGTGCGAGACAGGGTGGTGGTGGGCGTGCTTTTGATATCT

GGGGCCAAGGGACAATGGTCACCGTCTCAAGC 95. 806C-M0056-E08
L-Variable (AA):
QSALTQDPAVSVALGQTVKITCQGDSLRNYYASWYQQKPGQAPIVVIYGKNNRPSGIPDRFSGSR   (SEQ ID NO: 540)

SGSTASLTITGAQAVDEADYYCSSRDTTNYRMEFGGGTKLTVL

L-Variable (DNA):
CAGAGCGCTTTGACTCAGGACCCTGCTGTGTCTGTGGCCTTGGGACAGACAGTCAAGATCACATG   (SEQ ID NO: 541)

CCAAGGAGACAGTCTCAGAAATTATTATGCAAGCTGGTACCAGCAGAAGCCAGGACAGGCCCCTA

TAGTTGTCATCTATGGTAAA

AACAACCGGCCCTCAGGGATCCCAGACCGTTTCTCTGGCTCCAGGTCAGGAAGCACAGCTTCCTT

GACCATCACTGGGGCTCAGGCGGTAGATGAGGCTGACTATTACTGTAGTTCCCGGGACACTACTA

ATTACCGCATGGAATTCGGC

GGAGGGACCAAGCTGACTGTCCTA

H-Variable (AA):
EVQLLESGGGLVQPGGSLRLSCAASGFTFSSYIMANVRQAPGKGLEWVSGIYPSGGFTTYADSVK   (SEQ ID NO: 542)

GRFTISRDNSKNTLYLQMNSLRAEDTAVYYCAKIAGGAYHLDYWGQGTLVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 543)

CGCTGCTTCCGGATTCACTTTCTCTTCTTACATTATGGCTTGGGTTCGCCAAGCTCCTGGTAAAG

GTTTGGAGTGGGTTTCTGGT

ATCTATCCTTCTGGTGGCTTTACTACTTATGCTGACTCCGTTAAAGGTCGCTTCACTATCTCTAG

AGACAACTCTAAGAATACTCTACTTGCAGATGAACAGCTTAAGGGCTGAGGACACGGCTGTGT

ATTACTGTGCGAAAATTGCA

GGGGGAGCCTACCACCTTGATTACTGGGGCCAGGGAACCCTGGTCACCGTCTCAAGC 96. 806C-M0056-F01
L-Variable (AA):
QDIQMIQSPATLSLSPGERATLSCRASQSVSSYLAWYQQKPGQAPRLLIYDASNRATGIPARFSG   (SEQ ID NO: 544)

SGSGTDFTLTISSLEPEDFAVYYCQQRSNWPPALTFGGGTKVEIK

L-Variable (DNA):
CAAGACATCCAGATGATCCAGTCTCCAGCCACCCTGTCTTTGTCTCCAGGGGAAAGAGCCACCCT   (SEQ ID NO: 545)

CTCCTGCAGGGCCAGTCAGAGTGTTAGCAGCTACTTAGCCTGGTACCAACAGAAACCTGGCCAGG

CTCCCAGGCTCCTCATCTATGATGCATCCAACAGGGCCACTGGCATCCCAGCCAGGTTCAGTGGC

AGTGGGTCTGGGACAGACTTCACTCTCACCATCAGCAGCCTAGAGCCTGAAGATTTTGCAGTTTA

TTACTGTCAGCAGCGTAGCAACTGGCCTCCGGCCCTCACTTTCGGCGGAGGGACCAAGGTGGAGA

TCAAA
```

H-Variable (AA):
EVQLLESGGGLVQPGGSLRLSCAASGFTFSRYGMEWVRQAPGKGLEWVSSIYPSGGWTYYADSVK (SEQ ID NO: 546)
GRFTISRDNSKNTLYLQMNSLRAEDTAVYYCARRGSGRYFDYWGQGTLVTVSS H-Variable (DNA):
GAAGTTCAATTGTTAGAGTCTGGTGGCGGTCTTGTTCAGCCTGGTGGTTCTTTACGTCTTTCTTG (SEQ ID NO: 547)
CGCTGCTTCCGGATTCACTTTCTCTCGTTACGGTATGGAGTGGGTTCGCCAAGCTCCTGGTAAAG
GTTTGGAGTGGGTTTCTTCTATCTATCCTTCTGGTGGCTGGACTTATTATGCTGACTCCGTTAAA
GGTCGCTTCACTATCTCTAGAGACAACTCTAAGAATACTCTACTTGCAGATGAACAGCTTAAG
GGCTGAGGACACGGCCGTGTATTACTGTGCGAGACGGGGTAGTGGCCGGTACTTTGACTACTGGG
GCCAGGGCACCCTGGTCACCGTCTCAAGC 97. 806C-M0056-F02
L-Variable (AA):
QSELTQPPSASGSPGQSVTITCTGTSSDVGYYNYVSWYQQHPGKAPKLMIFEVSNRPSGVPDRFS (SEQ ID NO: 548)
GSKSGNTASLTVSGLQAEDEAHYYCSSYAGSDNFVFGSGTKVTVL L-Variable (DNA):
CAGAGCGAATTGACTCAGCCTCCCTCCGCGTCCGGGTCTCCTGGACAGTCAGTCACCATCACCTG (SEQ ID NO: 549)
CACTGGAACCAGCAGTGACGTTGGTTATTATAACTATGTCTCCTGGTATCAACAACACCCAGGCA
AAGCCCCCAAACTCATGATTTTTGAGGTCAGTAATCGGCCCTCAGGGGTCCCTGATCGCTTCTCT
GGCTCCAAGTCTGGCAACACGGCCTCCCTGACCGTCTCTGGGCTCCAGGCTGAGGATGAGGCTCA
TTATTACTGCAGCTCATATGCAGGCAGCGACAATTTTGTCTTCGGAAGTGGGACCAAGGTCACCG
TCTTA H-Variable (AA):
EVQLLESGGGLVQPGGSLRLSCAASGFTFSIYVMGWVRQAPGKGLEWVSSIYPSGGYTWYADSVK (SEQ ID NO: 550)
GRFTISRDNSKNTLYLQMNSLRAEDTAVYYCARQGGGGRAFDIWGQGTTVTVSS H-Variable (DNA):
GAAGTTCAATTGTTAGAGTCTGGTGGCGGTCTTGTTCAGCCTGGTGGTTCTTTACGTCTTTCTTG (SEQ ID NO: 551)
CGCTGCTTCCGGATTCACTTTCTCTATTTACGTTATGGGTTGGGTTCGCCAAGCTCCTGGTAAAG
GTTTGGAGTGGGTTTCTTCT
ATCTATCCTTCTGGTGGCTATACTTGGTATGCTGACTCCGTTAAAGGTCGCTTCACTATCTCTAG
AGACAACTCTAAGAATACTCTACTTGCAGATGAACAGCTTAAGGGCTGAGGACACGGCCGTGT
ATTACTGTGCGAGACAGGGA
GGAGGCGGTCGTGCTTTTGATATCTGGGGCCAAGGGACCACGGTCACCGTCTCAAGC 98. 806C-M0056-F10
L-Variable (AA):
QSVLTQPASVSGSPGQSITISCTGTSSDVGGYNYVSWYQQHPGKAPKLMIYDVSNRPSGVSNRFS (SEQ ID NO: 552)
GSKSGNTASLTISGLQAEDEADYYCSSYTSSSTLFYVFGTGTKVTVL L-Variable (DNA):
CAGAGCGTCTTGACTCAGCCTGCCTCCGTGTCTGGGTCTCCTGGACAGTCGATCACCATCTCCTG (SEQ ID NO: 553)
CACTGGAACCAGCAGTGACGTTGGTGGTTATAACTATGTCTCCTGGTACCAACAACACCCAGGCA
AAGCCCCCAAACTCATGATTTATGATGTCAGTAATCGGCCCTCAGGGGTTTCTAATCGCTTCTCT
GGCTCCAAGTCTGGCAACACGGCCTCCCTGACCATCTCTGGGCTCCAGGCTGAGGACGAGGCTGA
TTATTACTGCAGCTCATATACAAGCAGCAGCACTCTCTTTTATGTCTTCGGAACTGGGACCAAGG
TCACCGTCCTA H-Variable (AA):
EVQLLESGGGLVQPGGSLRLSCAASGFTFSRYKMMWVRQAPGKGLEWVSYIVPSGGWTYYADSVK (SEQ ID NO: 554)

GRFTISRDNSKNTLYLQMNSLRAEDTAVYYCARVDYYDFWSGYWWSGGYGMDVWGQGTTVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 555)

CGCTGCTTCCGGATTCACTTTCTCTCGTTACAAGATGATGTGGGTTCGCCAAGCTCCTGGTAAAG

GTTTGGAGTGGGTTTCTTATATCGTTCCTTCTGGTGGCTGGACTTATTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCGAGAGTTGACTATTACGATTTTTGGAGTGGTTATT

GGTGGTCGGGGGGGTACGGTATGGACGTCTGGGCCAAGGGACCACGGTCACCGTCTCAAGC 99. 806C-M0056-F11
L-Variable (AA):
QDIQMTQSPSFLSASVGDRVTITCRASQGISTYLAWYQQKPGKAPKLLIYATSTLQSGVPSRFSG (SEQ ID NO: 556)

SGSGTEFTLAISTLQPEDFATYYCQQLNSYPITFGQGTRLEIK

L-Variable (DNA):
CAAGACATCCAGATGACCCAGTCTCCATCCTTCCTGTCTGCATCTGTAGGAGACAGAGTCACCAT (SEQ ID NO: 557)

CACTTGCCGGGCCAGTCAGGGCATAAGCACTTATTTAGCCTGGTATCAGCAAAAGCCAGGGAAAG

CCCCTAAGCTCTTGATCTAT

GCTACATCCACTTTGCAAAGTGGAGTCCCATCAAGGTTCAGCGGCAGTGGGTCTGGGACAGAATT

CACTCTCGCAATCAGCACCCTGCAGCCTGAAGATTTTGCAACTTATTACTGTCAACAACTCAATA

GTTACCCGATCACTTTCGGC

CAAGGGACGCGACTGGAGATTAAA

H-Variable (AA):
EVQLLESGGGLVQPGGSLRLSCAASGFTFSRYVMLWVRQAPGKGLEWVSVIYPSGGYTYYADSVK (SEQ ID NO: 558)

GRFTISRDNSKNTLYLQMNSLRAEDTAVYYCARGVLRAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 559)

CGCTGCTTCCGGATTCACTTTCTCTCGTTACGTTATGCTTTGGGTTCGCCAAGCTCCTGGTAAAG

GTTTGGAGTGGGTTTCTGTT

ATCTATCCTTCTGGTGGCTATACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGGGGTA

CTAAGAGCTTTTGATATCTGGGGCCAAGGGACAATGGTCACCGTCTCAAGC 100. 806C-M0056-G03
L-Variable (AA):
QNIQMTQSPATLSLSPGERATLSCRASQSISSYLAWYQQKPGQVPRLLIYDASNRATGIPARFSG (SEQ ID NO: 560)

SGSGTDFTLTISRLEPEDFAVYYCQQYGSLPRTFGQGTKVEIK

L-Variable (DNA):
CAAAACATCCAGATGACCCAGTCTCCAGCCACCCTGTCTTTGTCTCCAGGGGAGAGAGCCACCCT (SEQ ID NO: 561)

CTCCTGCAGGGCCAGTCAGAGTATTAGCAGTTACTTAGCCTGGTATCAACAGAAACCTGGCCAGG

TTCCCAGGCTCCTCATCTAT

GATGCATCCAATAGGGCCACTGGCATCCCAGCCAGGTTCAGTGGCAGTGGGTCTGGGACAGACTT

CACTCTCACCATCAGCAGACTGGAGCCTGAAGATTTTGCAGTTTATTACTGTCAGCAGTATGGTA

GTTTACCTCGGACGTTCGGC

CAAGGGACCAAGGTGGAAATCAAA

-continued

H-Variable (AA):
EVQLLESGGGLVQPGGSLRLSCAASGFTFSKYKMHWVRQAPGKGLEWVSVIYPSGGKTYYADSVK (SEQ ID NO: 562)

GRFTISRDNSKNTLYLQMNSLRAEDTAVYYCAREMGGSGWYDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 563)

CGCTGCTTCCGGATTCACTTTCTCTAAGTACAAGATGCATTGGGTTCGCCAAGCTCCTGGTAAAG

GTTTGGAGTGGGTTTCTGTT

ATCTATCCATCTGGTGGCAAGACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGAAATG

GGTGGTAGTGGCTGGTACGACTACTGGGGCCAGGGAACCCTGGTCACCGTCTCAAGC 101. 806C-M0056-G04
L-Variable (AA):
QDIQMTQSPATLSLSPGARATLSCRASQSVSSYLAWYQQRPGQTPRLLIYGASSRATGIPDRFSG (SEQ ID NO: 564)

SGSGTDFTLTISRLEPEDFAVYYCQQYGSSRHTFGQGTKLEIK

L-Variable (DNA):
CAAGACATCCAGATGACCCAGTCTCCAGCCACCCTGTCTTTGTCTCCAGGGGCAAGAGCCACCCT (SEQ ID NO: 565)

CTCCTGCAGGGCCAGTCAGAGTGTTAGCAGCTACTTAGCCTGGTACCAACAGAGACCTGGCCAGA

CTCCCAGGCTCCTCATCTAT

GGTGCATCCAGCAGGGCCACTGGCATCCCAGACAGGTTCAGTGGCAGTGGGTCTGGGACAGACTT

CACTCTCACCATCAGCAGACTGGAGCCTGAAGATTTTGCAGTGTATTACTGTCAGCAGTATGGTA

GCTCACGACACACTTTTGGC

CAGGGGACCAAGCTGGAGATCAAA

H-Variable (AA):
EVQLLESGGGLVQPGGSLRLSCAASGFTFSQYVMRWVRQAPGKGLEWVSGIYPSGGWTTYADSVK (SEQ ID NO: 566)

GRFTISRDNSKNTLYLQMNSLRAEDTAVYYCATVAAAAGAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 567)

CGCTGCTTCCGGATTCACTTTCTCTCAGTACGTTATGCGTTGGGTTCGCCAAGCTCCTGGTAAAG

GTTTGGAGTGGGTTTCTGGT

ATCTATCCTTCTGGTGGCTGGACTACTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCAACAGTGGCA

GCAGCTGCGGGGCTTTTGATATCTGGGGCCAAGGGACAATGGTCACCGTCTCAAGC 102. 806C-M0056-G08
L-Variable (AA):
QDIQMTQSPGTLSLSPGERATLSCRASQSISSSYLAWYQQKPGQAPRLLLYGTSNRATGIPDRFS (SEQ ID NO: 568)

GSGSGTDFTLTISRLEPEDFALYYCQQRYKWPLTFGPGTKVDFK

L-Variable (DNA):
CAAGACATCCAGATGACCCAGTCTCCAGGCACCCTGTCTTTGTCTCCAGGGGAAAGAGCCACCCT (SEQ ID NO: 569)

CTCCTGCAGGGCCAGTCAGAGTATTAGCAGCAGCTACTTAGCCTGGTACCAGCAGAAACCTGGCC

AGGCTCCCCGGCTCCTCCTC

TATGGTACATCCAACAGGGCCACTGGCATCCCAGACAGGTTCAGTGGCAGTGGGTCTGGGACAGA

CTTCACTCTCACCATCAGCAGACTGGAGCCTGAAGACTTTGCACTTTATTACTGTCAGCAGCGTT

-continued

ACAAGTGGCCTCTCACTTTC

GGCCCTGGGACCAAGGTGGATTTCAAA

H-Variable (AA):
EVQLLESGGGLVQPGGSLRLSCAASGFTFSHYGMWWVRQAPGKGLEWVSVISPSGGQTNYADSVK (SEQ ID NO: 570)

GRFTISRDNSKNTLYLQMNSLRAEDTAVYYCAKGQIHGGNLASWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 571)

CGCTGCTTCCGGATTCACTTTCTCTCATTACGGTATGTGGTGGGTTCGCCAAGCTCCTGGTAAAG

GTTTGGAGTGGGTTTCTGTT

ATCTCTCCTTCTGGTGGCCAGACTAATTATGCTGACTCCGTTAAAGGTCGCTTCACTATCTCTAG

AGACAACTCTAAGAATACTCTCTACTTGCAGATGAACAGCTTAAGGGCTGAGGACACTGCCGTGT

ATTACTGTGCCAAAGGGCAA

ATCCACGGTGGTAATCTTGCCTCCTGGGGCCAGGGAACCCTGGTCACCGTCTCAAGC 103. 806C-M0056-G12
L-Variable (AA):
QSALTQPASVSGSPGQSITISCTGTSSDVGGYNYVSWYQQHPGKAPKLMISDVSNRPSGVSNRFS (SEQ ID NO: 572)

GSKSGNTASLTISGLQAEDEADYYCSSYTSSSTLYVFGTGTKVTVL

L-Variable (DNA):
CAGAGCGCTTTGACTCAGCCTGCCTCCGTGTCTGGGTCTCCTGGACAGTCGATCACCATCTCCTG (SEQ ID NO: 573)

CACTGGAACTAGCAGCGACGTTGGTGGTTATAACTATGTCTCCTGGTACCAACAGCACCCAGGCA

AAGCCCCCAAACTCATGATT

TCTGATGTCAGTAATCGGCCCTCAGGGGTTTCTAATCGCTTCTCTGGCTCCAAGTCTGGCAACAC

GGCCTCCCTGACCATCTCTGGGCTCCAGGCTGAGGACGAGGCTGATTATTACTGCAGCTCATATA

CAAGCAGCAGCACTCTGTAT

GTCTTCGGAACTGGGACCAAGGTCACCGTCCTA

H-Variable (AA):
EVQLLESGGGLVQPGGSLRLSCAASGFTFSNYKMNWVRQAPGKGLEWVSVIYPSGGATYYADSVK (SEQ ID NO : 574)

GRFTISRDNSKNTLYLQMNSLRAEDTAMYYCARVGYSSSWDPHFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 575)

CGCTGCTTCCGGATTCACTTTCTCTAATTACAAGATGAATTGGGTTCGCCAAGCTCCTGGTAAAG

GTTTGGAGTGGGTTTCTGTT

ATCTATCCTTCTGGTGGCGCTACTTATTATGCTGACTCCGTTAAAGGTCGCTTCACTATCTCTAG

AGACAACTCTAAGAATACTCTCTACTTGCAGATGAACAGCTTAAGGGCTGAGGACACCGCCATGT

ATTACTGTGCGAGAGTCGGG

TATAGCAGCAGCTGGGACCCCCACTTTGACTACTGGGGCCAGGGAACCCTGGTCACCGTCTCAAG

C 104. 806C-M0056-H04
L-Variable (AA):
QDIQMTQSPATLSLSPGERATLSCRASQSVSSSYLAWYQQKPGQAPRLLIYGASSRATGIPDRFS (SEQ ID NO: 576)

GSGSGTEFTLTISSLQSEDFGVYYCQQYKDWPRTFGQGTKVEIK

L-Variable (DNA):
CAAGACATCCAGATGACCCAGTCTCCAGCCACCCTGTCTTTGTCTCCAGGGGAAAGAGCCACCCT (SEQ ID NO: 577)

CTCCTGCAGGGCCAGTCAGAGTGTTAGCAGCAGCTACTTAGCCTGGTACCAGCAGAAACCTGGCC

-continued

AGGCTCCCAGGCTCCTCATC

TATGGTGCATCCAGCAGGGCCACTGGCATCCCAGACAGGTTCAGTGGCAGTGGGTCTGGGACAGA

GTTCACTCTCACCATCAGCAGCCTGCAGTCTGAAGATTTTGGAGTTTATTATTGTCAGCAGTATA

AGGACTGGCCTCGAACGTTC

GGCCAAGGGACCAAGGTGGAAATCAAA

H-Variable (AA):
EVQLLESGGGLVQPGGSLRLSCAASGFTFSSYRMVWVRQAPGKGLEWVSSIYPSGGPTRYADSVK (SEQ ID NO: 578)

GRFTISRDNSKNTLYLQMNSLRAEDTAVYYCARWSYYYDSSGYYPVSGPFDIWGQGTMVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 579)

CGCTGCTTCCGGATTCACTTTCTCTTCTTACCGTATGGTTTGGGTTCGCCAAGCTCCTGGTAAAG

GTTTGGAGTGGGTTTCTTCT

ATCTATCCTTCTGGTGGCCCTACTCGTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGATGGTCG

TATTACTATGATAGTAGTGGTTATTACCCCGTGAGTGGGCCTTTTGATATCTGGGGCCAAGGGAC

AATGGTCACCGTCTCAAGC 105. 806C-M0056-H12
L-Variable (AA):
QDIQMTQSPGTLSLSPGERATLSCRASQGVRSTYLAWYQQKPGQAPRLLIYGASSRATGIPDRFS (SEQ ID NO: 580)

GSGSGTDFTLTISRLEPEDFAVYYCQQYGSSQGFTFGPGTKVDIK

L-Variable (DNA):
CAAGACATCCAGATGACCCAGTCTCCAGGCACCCTGTCTTTGTCTCCAGGGGAAAGAGCCACCCT (SEQ ID NO: 581)

CTCCTGCAGGGCCAGTCAGGGTGTTAGAAGTACCTACTTAGCCTGGTACCAGCAGAAACCTGGCC

AGGCTCCCAGGCTCCTCATC

TATGGTGCATCCAGCAGGGCCACTGGCATCCCAGACAGGTTCAGTGGCAGTGGGTCTGGGACAGA

CTTCACTCTCACCATCAGCAGACTGGAGCCTGAAGATTTTGCAGTGTATTACTGTCAGCAGTATG

GTAGCTCACAGGGTTTCACT

TTCGGCCCTGGGACCAAAGTGGATATCAAA

H-Variable (AA):
EVQLLESGGGLVQPGGSLRLSCAASGFTFSMYKMHWVRQAPGKGLEWVSVIYPSGGITAYADSVK (SEQ ID NO: 582)

GRFTISRDNSKNTLYLQMNSLRADDTAVYYCTREVMGPSDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 583)

CGCTGCTTCCGGATTCACTTTCTCTATGTACAAGATGCATTGGGTTCGCCAAGCTCCTGGTAAAG

GTTTGGAGTGGGTTTCTGTT

ATCTATCCTTCTGGTGGCATTACTGCTTATGCTGACTCCGTTAAAGGTCGCTTCACTATCTCTAG

AGACAACTCTAAGAATACTCTCTACTTGCAGATGAACAGCTTAAGGGCTGATGACACAGCCGTGT

ATTACTGTACTAGAGAGGTT

ATGGGACCATCTGACTACTGGGGCCAGGGAACCCTGGTCACCGTCTCAAGC 106. 806C-M0057-B05
L-Variable (AA):
QDIQMTQSPATLSVSPGERATLSCRSSQSLSNNLAWYQQKPGQAPRLLIYGASTRATGIPARFSG (SEQ ID NO: 584)

SGSGTEFTLTISSLQSEDFATYYCQQANSFPRTFGQGTKLEIK

```
L-Variable (DNA):
CAAGACATCCAGATGACCCAGTCTCCAGCCACCCTGTCTGTGTCTCCAGGGGAAAGAGCCACCCT    (SEQ ID NO: 585)

CTCCTGCAGGTCCAGTCAGAGTCTTAGCAACAACTTAGCCTGGTACCAGCAGAAACCTGGCCAGG

CTCCCAGGCTCCTCATCTAT

GGTGCATCCACCAGGGCCACTGGCATCCCAGCCAGGTTCAGTGGCAGTGGGTCTGGGACAGAGTT

CACTCTCACCATCAGCAGCCTGCAGTCTGAAGATTTTGCAACTTACTATTGTCAACAGGCTAACA

GTTTCCCTCGAACTTTTGGC

CAGGGGACCAAGCTGGAGATCAAA

M-Variable (AA):
EVQLLESGGGLVQPGGSLRLSCAASGFTFSKYVMHWVRQAPGKGLEWVSSIYPSGGWTYYADSVK    (SEQ ID NO: 586)

GRFTISRDNSKNTLYLQMNSLRAEDTAVYYCATSTTYSSRPFDYWGQGTLVTVSS

H-Variable (DNA):
GAAGTTCAATTGTTAGAGTCTGGTGGCGGTCTTGTTCAGCCTGGTGGTTCTTTACGTCTTTCTTG    (SEQ ID NO: 587)

CGCTGCTTCCGGATTCACTTTCTCTAAGTACGTTATGCATTGGGTTCGCCAAGCTCCTGGTAAAG

GTTTGGAGTGGGTTTCTTCT

ATCTATCCTTCTGGTGGCTGGACTTATTATGCTGACTCCGTTAAAGGTCGCTTCACTATCTCTAG

AGACAACTCTAAGAATACTCTACTTGCAGATGAACAGCTTAAGGGCTGAGGACACGGCCGTGT

ATTACTGTGCGACCTCTACG

ACTTATAGCAGCAGGCCCTTTGACTATTGGGGCCAGGGAACCCTGGTCACCGTCTCAAGC 107. 806C-M0057-H07
L-Variable (AA):
QDIQMTQSPSSLSASVGDRVAITCRASQSIDTYLNWYQHKPGKAPKLLIYAASKLEDGVPSRFSG    (SEQ ID NO: 588)

SGTGTDFTLTIRSLQPEDFASYFCQQSYSSPGITFGPGTKVEIK

L-Variable (DNA):
CAAGACATCCAGATGACCCAGTCTCCATCCTCCCTGTCTGCATCTGTGGGAGACAGAGTCGCCAT    (SEQ ID NO: 589)

CACTTGCCGCGCAAGTCAGAGCATCGACACCTATTTAAATTGGTATCAGCACAAACCAGGGAAAG

CCCCTAAACTCCTGATCTAT

GCTGCATCCAAGTTGGAAGACGGGGTCCCATCAAGATTCAGTGGCAGTGGAACTGGGACAGATTT

CACTCTCACCATCAGAAGTCTGCAACCTGAAGATTTTGCAAGTTATTTCTGTCAACAGAGCTACT

CTAGTCCAGGGATCACTTTC

GGCCCTGGGACCAAGGTGGAGATCAAA

H-Variable (AA):
EVQLLESGGGLVQPGGSLRLSCAASGFTFSRYPMMWVRQAPGKGLEWVSVIYSSGGYTYYADSVK    (SEQ ID NO: 590)

GRFTISRDNSKNTLYLQMNSLRAEDTAVYYCARVSRGIYYAMDVWGQGTTVTVSS

H-Variable (DNA):
GAAGTTCAATTGTTAGAGTCTGGTGGCGGTCTTGTTCAGCCTGGTGGTTCTTTACGTCTTTCTTG    (SEQ ID NO: 591)

CGCTGCTTCCGGATTCACTTTCTCTCGTTACCCTATGATGTGGGTTCGCCAAGCTCCTGGTAAAG

GTTTGGAGTGGGTTTCTGTT

ATCTATTCTTCTGGTGGCTATACTTATTATGCTGACTCCGTTAAAGGTCGCTTCACTATCTCTAG

AGACAACTCTAAGAATACTCTACTTGCAGATGAACAGCTTAAGGGCTGAGGACACGGCCGTGT

ATTACTGTGCGAGAGTATCT

CGCGGGATCTACTACGCTATGGACGTCTGGGGCCAAGGGACCACGGTCACCGTCTCAAGC
```

10 108. 806C-M0058-A09
L-Variable (AA):
QDIQMTQSPGTLSLSPGERATLSCRASQSVSSSYLAWYQQKPGQAPRLLIYGASSRATGIPDRFS (SEQ ID NO: 592)

GSGSGTDFTLTISRLEPEDFVVYYCQQYGRSRYTFGQGTKLEIK

L-Variable (DNA):
CAAGACATCCAGATGACCCAGTCTCCAGGCACCCTGTCTTTGTCTCCAGGGGAAAGAGCCACCCT (SEQ ID NO: 593)

CTCCTGCAGGGCCAGTCAGAGTGTTAGCAGCAGCTACTTAGCCTGGTACCAGCAGAAACCTGGCC

AGGCTCCCAGGCTCCTCATC

TATGGTGCATCCAGCAGGGCCACTGGCATCCCAGACAGGTTCAGTGGCAGTGGGTCTGGGACAGA

CTTCACTCTCACCATCAGCAGACTGGAGCCTGAAGATTTTGTAGTGTATTACTGTCAGCAGTATG

GTAGGTCACGGTACACTTTT

GGCCAGGGGACCAAGCTGGAGATCAAA

H-Variable (AA):
EVQLLESGGGLVQPGGSLRLSCAASGFTFSNYKMHWVRQAPGKGLEWVSSIYPSGGPTHYADSVK (SEQ ID NO: 594)

GRFTISRDNSKNTLYLQMNSLRAEDTAVYYCAREGYSSGWYIHWYFDLWGRGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 595)

CGCTGCTTCCGGATTCACTTTCTCTAATTACAAGATGCATTGGGTTCGCCAAGCTCCTGGTAAAG

GTTTGGAGTGGGTTTCTTCTATCTATCCTTCTGGTGGCCCTACTCATTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCGAGAGAAGGGTATAGCAGTGGCTGGTACATTCACT

GGTACTTCGATCTCTGGGGCCGTGGCACCCTGGTCACCGTCTCAAGC 109. 806C-M0058-D04
L-Variable (AA):
QDIQMTQSPSSLSASVGDRVAITCRASQSIDTYLNWYQQKPGKAPKLLIYDASNLETGVPSRFSG (SEQ ID NO: 596)

SGSGTHFTFTISSLQPEDFATYYCQQADSFPITFGQGTRLEIK

L-Variable (DNA):
CAAGACATCCAGATGACCCAGTCTCCATCCTCCCTGTCTGCATCTGTGGGAGACAGAGTCGCCAT (SEQ ID NO: 597)

CACTTGCCGCGCAAGTCAGAGCATCGACACCTATTTAAATTGGTATCAGCAGAAACCAGGGAAAG

CCCCTAAGCTCCTGATCTAC

GATGCATCCAATTTGGAAACAGGGGTCCCATCAAGGTTCAGTGGAAGTGGATCTGGGACACACTT

TACCTTCACCATCAGCAGCCTGCAGCCTGAAGATTTTGCAACTTACTATTGTCAGCAGGCTGACA

GTTTCCCGATCACCTTCGGC

CAAGGGACACGACTGGAGATTAAA

H-Variable (AA):
EVQLLESGGGLVQPGGSLRLSCAASGFTFSSYFMTWVRQAPGKGLEWVSGISPSGGITSYADSVK (SEQ ID NO: 598)

GRFTISRDNSKNTLYLQMNSLRAEDTAVYYCAKGSYSDYGVFNSWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 599)

CGCTGCTTCCGGATTCACTTTCTCTTCTTACTTTATGACTTGGGTTCGCCAAGCTCCTGGTAAAG

GTTTGGAGTGGGTTTCTGGT

ATCTCTCCTTCTGGTGGCATTACTTCTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAAAGGCTCA

TACAGTGATTACGGGGTCTTTAATTCCTGGGGCCAGGGAACCCTGGTCACCGTCTCAAGC 110. 806C-M0058-E09
L-Variable (AA):
QDIQMTQSPATLSVSPGERATLSCRASQSISSSLAWYQQKPGQAPRLLIYDASNRATGIPARFSG  (SEQ ID NO: 600)

SGSGTDFTLTISSLEPEDFAVYYCQQRSNWPLTFGGGTKVEIK

L-Variable (DNA):
CAAGACATCCAGATGACCCAGTCTCCAGCCACCCTGTCTGTGTCTCCAGGGGAAAGAGCCACCCT  (SEQ ID NO: 601)

CTCCTGCAGGGCCAGTCAGAGTATTAGCAGCAGCTTAGCCTGGTACCAGCAGAAACCTGGCCAGG

CTCCCAGGCTCCTCATCTAT

GATGCATCCAACAGGGCCACTGGCATCCCAGCCAGGTTCAGTGGCAGTGGGTCTGGGACAGACTT

CACTCTCACCATCAGCAGCCTAGAGCCTGAAGATTTTGCAGTTTATTACTGTCAGCAGCGTAGCA

ACTGGCCGCTCACTTTCGGC

GGAGGGACCAAGGTGGAGATCAAA

H-Variable (AA):
EVQLLESGGGLVQPGGSLRLSCAASGFTFSNYVMAWVRQAPGKGLEWVSVIYPSGGATYYADSVK  (SEQ ID NO: 602)

GRFTISRDNSKNTLYLQMNSLRAEDTAVYYCTRLAVTHFDYWGQGTLVTVSS

H-Variable (DNA):
GAAGTTCAATTGTTAGAGTCTGGTGGCGGTCTTGTTCAGCCTGGTGGTTCTTTACGTCTTTCTTG  (SEQ ID NO: 603)

CGCTGCTTCCGGATTCACTTTCTCTAATTACGTTATGGCTTGGGTTCGCCAAGCTCCTGGTAAAG

GTTTGGAGTGGGTTTCTGTT

ATCTATCCTTCTGGTGGCGCTACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTACGAGACTGGCG

GTTACTCACTTTGACTACTGGGGCCAGGGAACCCTGGTCACCGTCTCAAGC 111. 806C-M0058-F03
L-Variable (AA):
QDIQMTQSPSTLSASVGDRVTITCRASQGISNYLAWYQQKPGKVPKLLIYGASNLQSGVSSRFSG  (SEQ ID NO: 604)

SGSATDFTLTISSLQPEDFATYYCQQFNSYPLTFGGGTKVEIK

L-Variable (DNA):
CAAGACATCCAGATGACCCAGTCTCCTTCCACCCTGTCTGCATCTGTAGGAGACAGAGTCACCAT  (SEQ ID NO: 605)

CACTTGCCGGGCGAGTCAGGGCATTAGCAATTATTTAGCCTGGTATCAACAGAAACCAGGGAAAG

TTCCTAAACTCCTGATCTAT

GGTGCATCTAATTTGCAGTCAGGGGTCTCATCGCGGTTCAGTGGCAGTGGATCTGCGACAGATTT

CACCCTCACCATCAGCAGCCTGCAGCCTGAAGATTTTGCAACTTATTACTGTCAACAGTTTAATA

GTTACCCTCTGACTTTCGGC

GGAGGGACCAAGGTGGAGATCAAA

H-Variable (AA):
EVQLLESGGGLVQPGGSLRLSCAASGFTFSDYGMAWVRQAPGKGLEWVSVISPSGGQTAYADSVK  (SEQ ID NO: 606)

GRFTISRDNSKNTLYLQMNSLRAEDTAVYYCATVRWFGAFDYWGQGTLVTVSS

H-Variable (DNA):
GAAGTTCAATTGTTAGAGTCTGGTGGCGGTCTTGTTCAGCCTGGTGGTTCTTTACGTCTTTCTTG  (SEQ ID NO: 607)

CGCTGCTTCCGGATTCACTTTCTCTGATTACGGTATGGCTTGGGTTCGCCAAGCTCCTGGTAAAG

GTTTGGAGTGGGTTTCTGTT

ATCTCTCCTTCTGGTGGCCAGACTGCTTATGCTGACTCCGTTAAAGGTCGCTTCACTATCTCTAG

AGACAACTCTAAGAATACTCTCTACTTGCAGATGAACAGCTTAAGGGCTGAGGACACGGCTGTGT

-continued

ATTACTGTGCCACAGTTAGA

TGGTTCGGGGCATTTGACTACTGGGGCCAGGGAACCCTGGTCACCGTCTCAAGC 112. 806C-M0058-G03
L-Variable (AA):
QDIQMTQSPGTLSLSPGERATLSCRASQSVTSSFLSWYQHRPGQAPRLLIYATSTRATGIPDRFS (SEQ ID NO: 608)

GSGSGTDFTLTISRLEPEDFAVYYCQHYHTSPPTYTFGQGTKLEIK

L-Variable (DNA):
CAAGACATCCAGATGACCCAGTCTCCAGGCACGCTGTCTTTGTCTCCAGGGGAAAGAGCCACCCT (SEQ ID NO: 609)

CTCCTGCAGGGCCAGTCAAAGTGTGACCAGCAGCTTCTTATCCTGGTACCAGCACAGACCTGGCC

AGGCTCCCAGGCTCCTCATCTATGCTACATCCACCAGGGCCACAGGCATCCCAGACAGGTTCAGT

GGCAGTGGGTCTGGGACAGACTTCACTCTCACTATCAGCAGACTGGAGCCTGAAGATTTTGCAGT

GTATTACTGTCAGCACTATCATACCTCACCTCCCACTTACACTTTTGGCCAGGGGACCAAGCTGG

AGATCAAA

H-Variable (AA):
EVQLLESGGGLVQPGGSLRLSCAASGFTFSLYLMYWVRQAPGKGLEWVSVIYPSGGWTYYADSVK (SEQ ID NO: 610)

GRFTISRDNSKNTLYLQMNSLRAEDTAMYYCARGYYYGMDVWGQGTTVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 611)

CGCTGCTTCCGGATTCACTTTCTCTCTTTACCTTATGTATTGGGTTCGCCAAGCTCCTGGTAAAG

GTTTGGAGTGGGTTTCTGTT

ATCTATCCTTCTGGTGGCTGGACTTATTATGCTGACTCCGTTAAAGGTCGCTTCACTATCTCTAG

AGACAACTCTAAGAATACTCTCTACTTGCAGATGAACAGCTTAAGGGCTGAGGACACCGCCATGT

ATTACTGTGCGAGAGGCTAC

TACTACGGTATGGACGTCTGGGGCCAAGGGACCACGGTCACCGTCTCAAGC 113. 806C-M0058-H01
L-Variable (AA):
QSALTQPPSVSVAPGETAEITCGGENIGSKSVHWYQQKPGQAPVLVIYYDNDRPSGIPERFSGSN (SEQ ID NO: 612)

FGSTATLTISRVEAGDEADYYCQVWDSGSEHYVFGTETKVTVLGQ

L-Variable (DNA):
CAGAGCGCTTTGACTCAGCCACCCTCAGTCTCAGTGGCCCCAGGGGAGACGGCCGAAATTACCTG (SEQ ID NO: 613)

TGGGGGCGAGAACATTGGAAGTAAAAGTGTCCATTGGTACCAGCAGAAGCCAGGCCAGGCCCCAG

TGCTGGTCATCTATTATGATAACGACCGCCCCTCAGGGATCCCTGAGCGATTCTCTGGCTCCAAC

TTTGGGAGCACGGCCACCCTGACCATCAGCAGGGTCGAAGCCGGGGATGAGGCCGACTATTACTG

TCAGGTCTGGGATAGTGGCAGTGAGCACTATGTCTTCGGAACTGAGACCAAGGTCACCGTCCTAG

GTCAG

H-Variable (AA):
EVQLLESGGGLVQPGGSLRLSCAASGFTFSGYIMMWVRQAPGKGLEWVSSIYPSGGHTYYADSVK (SEQ ID NO: 614)

GRFTISRDNSKNTLYLQMNSLRAEDTAVYYCARWYYGMDVWGQGTTVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 615)

CGCTGCTTCCGGATTCACTTTCTCTGGTTACATTATGATGTGGGTTCGCCAAGCTCCTGGTAAAG

GTTTGGAGTGGGTTTCTTCT

ATCTATCCTTCTGGTGGCCATACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

```
ATTACTGTGCGAGATGGTAT

TACGGTATGGACGTCTGGGGCCAAGGGACCACGGTCACCGTCTCAAGC
```

114. 806C-M0059-A02  
L-Variable (AA):  
QSALTQPASVSGSPGQSITISCTGTNSDVGGYNYVSWYQQHPGKAPKLIIFDVTNRPSGVSNRFS (SEQ ID NO: 616)

GSKAGNTASLTISGLQAEDEADYYCSSYSSTSPRFGGGTKLTVL

L-Variable (DNA):  
```
CAGAGCGCTTTGACTCAGCCTGCCTCCGTGTCAGGGTCTCCTGGACAGTCGATCACCATTTCCTG  (SEQ ID NO: 617)

CACTGGAACCAACAGTGACGTTGGTGGTTATAACTATGTCTCCTGGTACCAACAGCACCCAGGCA

AAGCCCCCAAACTCATAATTTTTGATGTCACTAATCGGCCCTCAGGGGTTTCTAATCGCTTCTCT

GGCTCCAAGGCTGGCAACACGGCCTCCCTGACCATCTCTGGGCTCCAGGCTGAGGACGAGGCTGA

TTATTACTGCAGCTCATATTCAAGTACCAGCCCTCGCTTCGGCGGAGGGACCAAGCTGACCGTCC

TG
```

H-Variable (AA):  
EVQLLESGGGLVQPGGSLRLSCAASGFTFSMYQMQWVRQAPGKGLEWVSRIYPSGGWTVYADSVK (SEQ ID NO: 618)

GRFTISRDNSKNTLYLQMNSLRAEDTAVYYCTRITYDSSGYYDYWGQGTLVTVSS

H-Variable (DNA):  
```
GAAGTTCAATTGTTAGAGTCTGGTGGCGGTCTTGTTCAGCCTGGTGGTTCTTTACGTCTTTCTTG  (SEQ ID NO: 619)

CGCTGCTTCCGGATTCACTTTCTCTATGTACCAGATGCAGTGGGTTCGCCAAGCTCCTGGTAAAG

GTTTGGAGTGGGTTTCTCGTATCTATCCTTCTGGTGGCTGGACTGTTTATGCTGACTCCGTTAAA

GGTCGCTTCACTATCTCTAGAGACAACTCTAAGAATACTCTCTACTTGCAGATGAACAGCTTAAG

GGCTGAGGACACAGCCGTGTATTACTGTACACGGATCACGTATGATAGTAGTGGTTATTACGACT

ACTGGGGCCAGGGAACCCTGGTCACCGTCTCAAGC
```

115. 806C-M0059-A06  
L-Variable (AA):  
QDIQMTQSPSSLSASVGDRVAITCRASQSIDTYLNWYQHKPGKAPKLLIYAASKLEDGVPSRFSG (SEQ ID NO: 620)

SGTGTDFTLTIRSLQPEDFASYFCQQSYSSPGITFGPGTKVEIK

L-Variable (DNA):  
```
CAAGACATCCAGATGACCCAGTCTCCATCCTCCCTGTCTGCATCTGTGGGAGACAGAGTCGCCAT  (SEQ ID NO: 621)

CACTTGCCGCGCAAGTCAGAGCATCGACACCTATTTAAATTGGTATCAGCACAAACCAGGGAAAG

CCCCTAAACTCCTGATCTATGCTGCATCCAAGTTGGAAGACGGGGTCCCATCAAGATTCAGTGGC

AGTGGAACTGGGACAGATTTCACTCTCACCATCAGAAGTCTGCAACCTGAAGATTTTGCAAGTTA

TTTCTGTCAACAGAGCTACTCTAGTCCAGGGATCACTTTCGGCCCTGGGACCAAGGTGGAGATCA

AA
```

H-Variable (AA):  
EVQLLESGGGLVQPGGSLRLSCAASGFTFSPYKMIWVRQAPGKGLEWVSGIYPSGGWTYYADSVK (SEQ ID NO: 622)

GRFTISRDNSKNTLYLQMNSLRAEDTAMYYCARLLPALRGAVMDVWGQGTTVTVSS

H-Variable (DNA):  
```
GAAGTTCAATTGTTAGAGTCTGGTGGCGGTCTTGTTCAGCCTGGTGGTTCTTTACGTCTTTCTTG  (SEQ ID NO: 623)

CGCTGCTTCCGGATTCACTTTCTCTCCTTACAAGATGATTTGGGTTCGCCAAGCTCCTGGTAAAG

GTTTGGAGTGGGTTTCTGGTATCTATCCTTCTGGTGGCTGGACTTATTATGCTGACTCCGTTAAA

GGTCGCTTCACTATCTCTAGAGACAACTCTAAGAATACTCTCTACTTGCAGATGAACAGCTTAAG

GGCTGAGGACACCGCCATGTATTACTGTGCGAGACTGTTACCAGCCTTGCGGGGAGCCGTGATGG

ACGTCTGGGGCCAAGGGACCACGGTCACCGTCTCAAGC
```

-continued

```
 116. 806C-M0060-B02
L-Variable (AA):
QSVLTQDPTVSVALGQTVRITCRGDRLRSYYSSWYQQKPRQAPVLVMFGRNNRPSGIPDRFSGST    (SEQ ID NO: 624)

SGSTASLTITATQADDEADYFCSSRDGSGNFLFGGGTKLTVL

L-Variable (DNA):
CAGAGCGTCTTGACTCAGGACCCTACTGTGTCTGTGGCCTTGGGGCAGACAGTCAGGATCACATG   (SEQ ID NO: 625)

CCGAGGAGACAGACTCAGAAGTTATTATTCAAGTTGGTACCAGCAGAAGCCACGACAGGCCCCTG

TTCTTGTCATGTTTGGTAGAAACAACCGGCCCTCAGGGATCCCAGACCGATTCTCTGGCTCCACC

TCAGGAAGCACAGCTTCCTTGACCATCACTGCGACTCAGGCGGACGATGAGGCTGACTATTTCTG

TAGTTCCCGGGACGGCAGTGGTAATTTCCTCTTCGGCGGAGGGACCAAACTGACCGTCCTT

H-Variable (AA):
EVQLLESGGGLVQPGGSLRLSCAASGFTFSIYPMHWVRQAPGKGLEWVSSIYPSGGITRYADSVK   (SEQ ID NO: 626)

GRFTISRDNSKNTLYLQMNSLRAEDTALYYCARQRGSGWHDSWGQGTLVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 627)

CGCTGCTTCCGGATTCACTTTCTCTATTTACCCTATGCATTGGGTTCGCCAAGCTCCTGGTAAAG

GTTTGGAGTGGGTTTCTTCT

ATCTATCCTTCTGGTGGCATTACTCGTTATGCTGACTCCGTTAAAGGTCGCTTCACTATCTCTAG

AGACAACTCTAAGAATACTCTCTACTTGCAGATGAACAGCTTAAGGGCTGAGGACACCGCCTTGT

ATTACTGTGCGAGACAACGG

GGCAGTGGCTGGCATGACTCCTGGGGCCAGGGAACCCTGGTCACCGTCTCAAGC 117. 806C-M0060-H01
L-Variable (AA):
QDIQMTQSPATLSLSPGERATLSCRASQSVSSYLAWYQQKPGQAPRLLIYDASNRATGIPARFSG   (SEQ ID NO: 628)

SGSGTDFTLTISSLEPEDFAVYYCQQRSNWPVTFGQGTRLEIK

L-Variable (DNA):
CAAGACATCCAGATGACCCAGTCTCCAGCCACCCTGTCTTTGTCTCCAGGGGAAAGAGCCACCCT   (SEQ ID NO: 629)

CTCCTGCAGGGCCAGTCAGAGTGTTAGCAGCTACTTAGCCTGGTACCAACAGAAACCTGGCCAGG

CTCCCAGGCTCCTCATCTAT

GATGCATCCAACAGGGCCACTGGCATCCCAGCCAGGTTCAGTGGCAGTGGGTCTGGGACAGACTT

CACTCTCACCATCAGCAGCCTAGAGCCTGAAGATTTTGCAGTTTATTACTGTCAGCAGCGTAGCA

ACTGGCCGGTCACCTTCGGC

CAAGGGACACGACTGGAGATTAAA

H-Variable (AA):
EVQLLESGGGLVQPGGSLRLSCAASGFTFSYYPMVWVRQAPGKGLEWVSVIVPSGGFTAYADSVK   (SEQ ID NO: 630)

GRFTISRDNSKNTLYLQMNSLRAEDTAMYYCARKRPGNAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 631)

CGCTGCTTCCGGATTCACTTTCTCTTATTACCCTATGGTTTGGGTTCGCCAAGCTCCTGGTAAAG

GTTTGGAGTGGGTTTCTGTTATCGTTCCTTCTGGTGGCTTTACTGCTTATGCTGACTCCGTTAAA

GGTCGCTTCACTATCTCTAGAGACAACTCTAAGAATACTCTCTACTTGCAGATGAACAGCTTAAG

GGCTGAGGACACCGCCATGTATTACTGTGCGAGAAAGCGACCTGGAAATGCTTTTGATATCTGGG

GCCAAGGGACAATGGTCACCGTCTCAAGC
```

118. 806C-M0061-A03
L-Variable (AA):
QDIQMTQSPSFLSASVGDSVAITCRASQDISRFLAWYQQRPGKAPKLLIFSASTLQSGVPSRFSG (SEQ ID NO: 632)

SGSGTEFTLTINALQPEDFATYYCQQLSRYSTFGQGTKLEIK

L-Variable (DNA):
CAAGACATCCAGATGACCCAGTCTCCATCCTTCCTGTCTGCATCTGTAGGAGACAGTGTCGCCAT (SEQ ID NO: 633)

CACTTGCCGGGCCAGTCAGGACATTAGTCGTTTTTTAGCCTGGTATCAGCAAAGACCAGGGAAAG

CCCCTAAACTCCTGATTTTT

TCTGCTTCCACTTTACAAAGTGGGGTCCCATCCAGGTTCAGCGGCAGTGGATCTGGGACAGAATT

TACTCTCACAATCAACGCCCTGCAGCCTGAAGATTTTGCAACTTATTACTGTCAACAACTTAGTC

GTTATTCGACGTTCGGCCAAGGCACCAAACTGGAAATCAAA

H-Variable (AA):
EVQLLESGGGLVQPGGSLRLSCAASGFTFSYYKMWWVRQAPGKGLEWVSSISPGGWTHYADSVKG (SEQ ID NO: 634)

RFTISRDNSKNTLYLQMNSLRAEDTAVYYCARGPVSSGGDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 635)

CGCTGCTTCCGGATTCACTTTCTCTTATTACAAGATGTGGTGGGTTCGCCAAGCTCCTGGTAAAG

GTTTGGAGTGGGTTTCTTCTATCTCTCCTGGTGGCTGGACTCATTATGCTGACTCCGTTAAAGGT

CGCTTCACTATCTCTAGAGACAACTCTAAGAATACTCTCTACTTGCAGATGAACAGCTTAAGGGC

TGAGGACACGGCCGTGTATTACTGTGCTAGAGGCCCTGTCAGTAGTGGTGGGGACTACTGGGGCC

AGGGAACCCTGGTACCGTCTCAAGC 119. 806C-M0061-C05
L-Variable (AA):
QDIQMTQSPATLSLSPGERATLSCRASQSVSSYLAWYQQKPGQAPRLLIYDASNRATGIPARFSG (SEQ ID NO: 636)

SGSGTDFTLTISSLEPEDFAVYYCQQRSNWPPLTFGGGTKVEIK

L-Variable (DNA):
CAAGACATCCAGATGACCCAGTCTCCAGCCACCCTGTCTTTGTCTCCAGGGGAAAGAGCCACCCT (SEQ ID NO: 637)

CTCCTGCAGGGCCAGTCAGAGTGTTAGCAGCTACTTAGCCTGGTACCAACAGAAACCTGGCCAGG

CTCCCAGGCTCCTCATCTAT

GATGCATCCAACAGGGCCACTGGCATCCCAGCCAGGTTCAGTGGCAGTGGGTCTGGGACAGACTT

CACTCTCACCATCAGCAGCCTAGAGCCTGAAGATTTTGCAGTTTATTACTGTCAGCAGCGTAGCA

ACTGGCCTCCGCTCACTTTC

GGCGGAGGGACCAAGGTGGAGATCAAA

H-Variable (AA):
EVQLLESGGGLVQPGGSLRLSCAASGFTFSQYVMMWVRQAPGKGLEWVSSIYPSGGQTYYADSVK (SEQ ID NO: 638)

GRFTISRDNSKNTLYLQMNSLRAEDTAVYYCAKIAGGAYHLDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 639)

CGCTGCTTCCGGATTCACTTTCTCTCAGTACGTTATGATGTGGGTTCGCCAAGCTCCTGGTAAAG

GTTTGGAGTGGGTTTCTTCTATCTATCCTTCTGGTGGCCAGACTTATTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCGAAAATTGCAGGGGGAGCCTACCACCTTGATTACT

GGGGCCAGGGAACCCTGGTCACCGTCTCAAGC

-continued

```
 120. 806C-M0061-C06
L-Variable (AA):
QYELTQPASVSGSPGQSITISCTGTSSDVGGYNYVSWYQQHPGKAPKLTIFDVTKRPSGVSDRFS    (SEQ ID NO: 640)

GSKSDNTASLTISGLQAEDEADYYCGSYTSSGSRVFGTGTKVTVL

L-Variable (DNA):
CAGTACGAATTGACTCAGCCTGCCTCCGTGTCTGGGTCTCCTGGACAGTCGATCACCATCTCCTG    (SEQ ID NO: 641)

CACTGGAACCAGCAGTGACGTTGGTGGTTATAACTATGTCTCCTGGTACCAACAACACCCAGGCA

AAGCCCCCAAACTCACGATT

TTTGATGTCACTAAACGGCCCTCAGGGGTTTCTGATCGCTTCTCTGGCTCCAAGTCTGACAATAC

GGCCTCCCTGACCATCTCTGGGCTCCAGGCTGAAGACGAAGCTGATTATTACTGCGGCTCATATA

CAAGCAGCGGCTCTCGGGTC

TTCGGAACTGGGACCAAGGTCACCGTCCTC

H-Variable (AA):
EVQLLESGGGLVQPGGSLRLSCAASGFTFSRYVMGWVRQAPGKGLEWVSRIYPSGGFTYYADSVK    (SEQ ID NO: 642)

GRFTISRDNSKNTLYLQMNSLRAEDTAVYYCTRIREGYFDYWGQGTLVTVSS

H-Variable (DNA):
GAAGTTCAATTGTTAGAGTCTGGTGGCGGTCTTGTTCAGCCTGGTGGTTCTTTACGTCTTTCTTG    (SEQ ID NO: 643)

CGCTGCTTCCGGATTCACTTTCTCTCGTTACGTTATGGGTTGGGTTCGCCAAGCTCCTGGTAAAG

GTTTGGAGTGGGTTTCTCGTATCTATCCTTCTGGTGGCTTTACTTATTATGCTGACTCCGTTAAA

GGTCGCTTCACTATCTCTAGAGACAACTCAAGAATACTCTCTACTTGCAGATGAACAGCTTAAG

GGCTGAGGACACGGCCGTGTATTACTGTACGAGGATAAGGGAAGGGTACTTTGACTACTGGGCC

AGGGAACCCTGGTCACCGTCTCAAGC 121. 806C-M0061-F07
L-Variable (AA):
QDIQMTQSPSSLSASVGDRVAITCRASQSIDTYLNWYQQKPGKAPKLLIYAASKLEDGVPSRFSG    (SEQ ID NO: 644)

SGTGTDFTLTIRSLQPEDFASYFCQQSYSSPGITFGPGTKVEIK

L-Variable (DNA):
CAAGACATCCAGATGACCCAGTCTCCATCCTCCCTGTCTGCATCTGTGGGAGACAGAGTCGCCAT    (SEQ ID NO: 645)

CACTTGCCGCGCAAGTCAGAGCATCGACACCTATTTAAATTGGTATCAGCAGAAACCAGGGAAAG

CCCCTAAACTCCTGATCTATGCTGCATCCAAGTTGGAAGACGGGGTCCCATCAAGATTCAGTGGC

AGTGGAACTGGGACAGATTTCACTCTCACCATCAGAAGTCTGCAACCTGAAGATTTTGCAAGTTA

TTTCTGTCAACAGAGCTACTCTAGTCCAGGGATCACTTTCGGCCCTGGGACCAAGGTGGAGATCA

AA

H-Variable (AA):
EVQLLESGGGLVQPGGSLRLSCAASGFTFSHYVMTWVRQAPGKGLEWVSSIYPSGGFTAYADSVT    (SEQ ID NO: 646)

GRFTISRDNSKNTLYLQMNSLRAEDTAMYYCAKSTYYYEGSGYYRAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG    (SEQ ID NO: 647)

CGCTGCTTCCGGATTCACTTTCTCTCATTACGTTATGACTTGGGTTCGCCAAGCTCCTGGTAAAG

GTTTGGAGTGGGTTTCTTCTATCTATCCTTCTGGTGGCTTTACTGCTTATGCTGACTCCGTTACA

GGTCGCTTCACTATCTCTAGAGACAACTCAAGAATACTCTCTACTTGCAGATGAACAGCTTAAG

GGCTGAGGACACCGCCATGTATTACTGTGCGAAATCGACT

TATTACTATGAGGGTAGTGGTTATTACCGCGCTTTTGATATCTGGGGCCAAGGGACAATGGTCAC

CGTCTCAAGC
```

```
122. 806C-M0061-G12
L-Variable (AA):
QDIQMTQSPATLSLSPGERATLSCRASQSVSSSYLAWYQQKPGQAPRLLIYGASNRATGIPARFS    (SEQ ID NO: 648)

GSGSGTDFTLTISGLEPEDFVVYYCQKYGSSSLTFGGGTKVEIK

L-Variable (DNA):
CAAGACATCCAGATGACCCAGTCTCCAGCCACCCTGTCTCTATCTCCAGGGGAAAGAGCCACCCT   (SEQ ID NO: 649)

CTCCTGCAGGGCCAGTCAGAGTGTTAGCAGCAGCTACTTAGCCTGGTACCAGCAGAAACCTGGCC

AGGCTCCCAGGCTCCTCATC

TATGGTGCATCCAACAGGGCCACTGGCATCCCAGCCAGGTTCAGTGGCAGTGGGTCTGGGACAGA

CTTCACTCTCACCATCAGTGGCCTGGAGCCTGAAGATTTTGTAGTGTATTACTGTCAGAAGTATG

GTAGTTCATCGCTCACTTTC

GGCGGAGGGACCAAGGTGGAGATCAAA

H-Variable (AA):
EVQLLESGGGLVQPGGSLRLSCAASGFTFSQYKMWWVRQAPGKGLEWVSVIYPSGGVTYYADSVK   (SEQ ID NO: 650)

GRFTISRDNSKNTLYLQMNSLRAEDTAVYYCAISYSPVGAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 651)

CGCTGCTTCCGGATTCACTTTCTCTCAGTACAAGATGTGGTGGGTTCGCCAAGCTCCTGGTAAAG

GTTTGGAGTGGGTTTCTGTT

ATCTATCCTTCTGGTGGCGTTACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGATCTCGTAT

AGTCCCGTGGGGCTTTTGATATCTGGGGCCAAGGGACAATGGTCACCGTCTCAAGC 123. 806C-M0061-H09
L-Variable (AA):
QSALTQPPSVSGSPGQSVTISCTGTSSDVGSYNRVSWYRQPPGTAPKVIIYDINNRPSGVPDRFS   (SEQ ID NO: 652)

GSRSGDTAYLTISGLQVEDEADYYCSSFTSSSTYIFGTGTKVTVL

L-Variable (DNA):
CAGAGCGCTTTGACTCAGCCTCCCTCCGTGTCCGGGTCTCCTGGACAGTCAGTCACCATTTCCTG   (SEQ ID NO: 653)

CACTGGAACCAGCAGTGACGTTGGTAGTTATAACCGTGTCTCCTGGTACCGGCAGCCCCCAGGCA

CAGCCCCCAAAGTCATCATT

TATGACATCAATAATCGGCCCTCAGGTGTCCCTGATCGCTTCTCTGGGTCCAGGTCTGGCGACAC

GGCCTACCTGACCATCTCTGGGCTCCAGGTGGAGGACGAGGCTGATTATTACTGTAGCTCATTTA

CAAGCAGCAGCACCTATATC

TTCGGAACTGGGACCAAGGTCACCGTCCTG

H-Variable (AA):
EVQLLESGGGLVQPGGSLRLSCAASGFTFSVYKMYWVRQAPGKGLEWVSVIYPSGGYTDYADSVK   (SEQ ID NO: 654)

GRFTISRDNSKNTLYLQMNSLRAEDTAVYYCARQLPMSYFDYWGQGTLVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 655)

CGCTGCTTCCGGATTCACTTTCTCTGTTTACAAGATGTATTGGGTTCGCCAAGCTCCTGGTAAAG

GTTTGGAGTGGGTTTCTGTTATCTATCCTTCTGGTGGCTATACTGATTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCGCGGCAGCTGCCCATGTCGTACTTTGACTACTGGG

GCCAGGGAACCCTGGTCACCGTCTCAAGC
```

-continued 124. 806C-M0062-A12
L-Variable (AA):
QDIQMTQSPLSLPVTPGEPASMSCRSSQSLLQSNGYNYLDWYLQKPGQSPQLLIYLGSNRASGVP     (SEQ ID NO: 656)

DRFSGSGSGTDFTLKISRVEAEDVGVYYCMQALQTWTFGQGTKVEIK

L-Variable (DNA):
CAAGACATCCAGATGACCCAGTCTCCACTCTCCCTGCCCGTCACCCCTGGAGAGCCGGCCTCCAT     (SEQ ID NO: 657)

GTCCTGCAGGTCTAGTCAGAGCCTCCTGCAAAGTAATGGATACAACTATTTGGATTGGTACCTGC

AGAAGCCAGGGCAGTCTCCACAGCTCCTGATCTATTTGGGTTCTAATCGGGCCTCCGGGGTCCCT

GACAGGTTCAGTGGCAGTGGATCAGGCACAGATTTTACACTGAAAATCAGCAGAGTGGAGGCTGA

GGATGTTGGGGTTTATTACTGCATGCAAGCTCTACAAACTTGGACGTTCGGCCAAGGGACCAAGG

TGGAAATCAAA

H-Variable (AA):
EVQLLESGGGLVQPGGSLRLSCAASGFTFSRYVMVWVRQAPGKGLEWVSRIYPSGGFTNYADSVK     (SEQ ID NO: 658)

GRFTISRDNSKNTLYLQMNSLRAEDTAVYYCARDKTAHMDVWGKGTTVTVSS

H-Variable (DNA):
GAAGTTCAATTGTTAGAGTCTGGTGGCGGTCTTGTTCAGCCTGGTGGTTCTTTACGTCTTTCTTG     (SEQ ID NO: 659)

CGCTGCTTCCGGATTCACTTTCTCTCGTTACGTTATGGTTTGGGTTCGCCAAGCTCCTGGTAAAG

GTTTGGAGTGGGTTTCGCGTATCTATCCTTCTGGTGGCTTTACTAATTATGCTGACTCCGTTAAA

GGTCGCTTCACTATCTCTAGAGACAACTCTAAGAATACTCTCTACTTGCAGATGAACAGCTTAAG

GGCTGAGGACACGGCCGTGTATTACTGTGCGAGAGATAAGACAGCCCACATGGACGTCTGGGGCA

AAGGGACCACGGTCACCGTCTCAAGC 125. 806C-M0062-B05
L-Variable (AA):
QDIQMTQSPATLSLSPGERATLSCPASQSVSSYLAWYQQKPGQAPRLLIYDASNRATGIPARFSG     (SEQ ID NO: 660)

SGSGTDFTLTISSLEPEDFAVYYCQQRSSWPPLTFGGGTKVEIK

L-Variable (DNA):
CAAGACATCCAGATGACCCAGTCTCCAGCCACCCTGTCTTTGTCTCCAGGGGAAAGAGCCACCCT     (SEQ ID NO: 661)

CTCCTGCAGGGCCAGTCAGAGTGTTAGCAGCTACTTAGCCTGGTACCAACAGAAACCTGGCCAGG

CTCCCAGGCTCCTCATCTATGATGCATCCAACAGGGCCACTGGCATCCCAGCCAGGTTCAGTGGC

AGTGGGTCTGGGACAGACTTCACTCTCACCATCAGCAGCCTAGAGCCTGAAGATTTTGCAGTTTA

TTACTGTCAGCAGCGTAGCAGCTGGCCTCCGCTCACTTTCGGCGGAGGGACCAAGGTGGAGATCA

AG

H-Variable (AA):
EVQLLESGGGLVQPGGSLRLSCAASGFTFSRYKMNWVRQAPGKGLEWVSSIYPSGGWTNYADSVK     (SEQ ID NO: 662)

GRFTISRDNSKNTLYLQMNSLRAEDTAVYYCARGGRYGDYVRHWGQGTLVTVSS

H-Variable (DNA):
GAAGTTCAATTGTTAGAGTCTGGTGGCGGTCTTGTTCAGCCTGGTGGTTCTTTACGTCTTTCTTG     (SEQ ID NO: 663)

CGCTGCTTCCGGATTCACTTTCTCTCGTTACAAGATGAATTGGGTTCGCCAAGCTCCTGGTAAAG

GTTTGGAGTGGGTTTCTTCT

ATCTATCCTTCTGGTGGCTGGACTAATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCCAGAGGGGGG

AGATACGGTGACTACGTGCGTCACTGGGGCCAGGGAACCCTGGTCACCGTCTCAAGC

-continued 126. 806C-M0062-B07
L-Variable (AA):
QDIQMTQSPATLSVSPGERATLSCRASQSVSSNLAWYQHKPGQAPRLLIYGASIRATGIPARFSG (SEQ ID NO: 664)

SGSGTEFTLTISSLQSEDFGVYYCQQYKDWPRTFGQGTKVEIK

L-Variable (DNA):
CAAGACATCCAGATGACCCAGTCTCCAGCCACCCTGTCTGTGTCTCCAGGGGAAAGAGCCACTCT (SEQ ID NO: 665)

CTCCTGCAGGGCCAGTCAGAGTGTTAGCAGCAACTTAGCCTGGTACCAGCACAAACCTGGCCAGG

CTCCCAGGCTCCTCATCTAT

GGTGCATCCATCAGGGCCACTGGTATCCCAGCCAGGTTCAGTGGCAGTGGGTCTGGGACAGAGTT

CACTCTCACCATCAGCAGCCTGCAGTCTGAAGATTTTGGAGTTTATTATTGTCAGCAGTATAAGG

ACTGGCCTCGAACGTTCGGC

CAAGGGACCAAGGTGGAAATCAAA

H-Variable (AA):
EVQLLESGGGLVQPGGSLRLSCAASGFTFSRYRMAWVRQAPGKGLEWVSSIYPSGGVTYYADSVK (SEQ ID NO: 666)

GRFTISRDNSKNTLYLQMNSLRAEDTAVYYCARDLSIAAAGTAYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 667)

CGCTGCTTCCGGATTCACTTTCTCTCGTTACCGTATGGCTTGGGTTCGCCAAGCTCCTGGTAAAG

GTTTGGAGTGGGTTTCTTCT

ATCTATCCTTCTGGTGGCGTTACTTATTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCAAGAGATCTT

AGTATAGCAGCAGCTGGTACTGCCTACTGGGGCCAGGGAACCCTGGTCACCGTCTCAAGC 127. 806C-M0062-C08
L-Variable (AA):
QDIQMTQSPGTLSLSPGERATLSCRASQSFVGSRNLAWYQQKPGQPPRLLIYGAFNRATGIPGRF (SEQ ID NO: 668)

SGSGSGTDFTLTISRLEPEDFAVYYCQQYGTSPRTFGGGTKVEIK

L-Variable (DNA):
CAAGACATCCAGATGACCCAGTCTCCAGGCACGCTGTCTTTGTCTCCAGGGGAAAGAGCCACCCT (SEQ ID NO: 669)

CTCCTGCAGGGCCAGTCAGAGTTTTGTCGGCAGCAGAAACTTAGCCTGGTACCAGCAAAAACCTG

GCCAGCCTCCCAGGCTCCTCATCTATGGTGCATTCAACAGGGCCACTGGCATCCCAGGCAGGTTT

AGTGGCAGTGGCTCTGGGACAGACTTCACTCTCACCATCAGCAGACTGGAGCCTGAAGATTTTGC

AGTGTATTACTGTCAGCAGTATGGTACGTCACCTCGGACTTTCGGCGGAGGGACCAAAGTGGAGA

TCAAA

H-Variable (AA):
EVQLLESGGGLVQPGGSLRLSCAASGFTFSRYVMQWVRQAPGKGLEWFSSIYPSGGATIYADSVK (SEQ ID NO: 670)

GRFTISRDNSKNTLYLQMNSLRAEDTAVYYCARRGIPGYFDSWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 671)

CGCTGCTTCCGGATTCACTTTCTCTCGTTACGTTATGCAGTGGGTTCGCCAAGCTCCTGGTAAAG

GTTTGGAGTGGTTTTCTTCT

ATCTATCCTTCTGGTGGCGCTACTATTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAAGGGGA

ATTCCGGGCTACTTTGACTCCTGGGGCCAGGGAACCCTGGTCACCGTCTCAAGC

-continued 128. 806C-M0062-D04
L-Variable (AA):
QDIQMTQSPLSLSASIGDRVTITCRASQSISTYLNWYQQKPGKAPKLLIYATSTLQSGVPSRFSG  (SEQ ID NO: 672)

SGSGTEFILTISGLQPEDFATYYCQQFNFYPLTLGGGTRVEIKRT

L-Variable (DNA):
CAAGACATCCAGATGACCCAGTCTCCACTCTCCCTGTCTGCATCTATAGGAGACAGAGTCACCAT  (SEQ ID NO: 673)

CACTTGCCGGGCAAGTCAGAGCATTAGCACCTATTTAAATTGGTATCAGCAGAAGCCAGGGAAAG

CCCCTAAACTCCTGATCTAT

GCAACTTCCACTTTACAGAGTGGGGTCCCATCAAGGTTCAGCGGCAGTGGATCTGGGACAGAATT

CATTCTCACAATCAGCGGCCTGCAGCCTGAAGATTTTGCAACTTATTACTGTCAACAGTTTAATT

TTTATCCTCTCACTCTCGGC

GGAGGGACCAGGGTGGAGATCAAACGAACT

H-Variable (AA):
EVQLLESGGGLVQPGGSLRLSCAASGFTFSSYGMVWVRQAPGKGLEWVSSISPSGGNTGYADSVK  (SEQ ID NO: 674)

GRFTISRDNSKNTLYLQMNSLRAEDTAVYYCARGNGGFDSWGQGTLVTVSS

H-Variable (DNA):
GAAGTTCAATTGTTAGAGTCTGGTGGCGGTCTTGTTCAGCCTGGTGGTTCTTTACGTCTTTCTTG  (SEQ ID NO: 675)

CGCTGCTTCCGGATTCACTTTCTCTTCTTACGGTATGGTTTGGGTTCGCCAAGCTCCTGGTAAAG

GTTTGGAGTGGGTTTCTTCT

ATCTCTCCTTCTGGTGGCAATACTGGTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCAAGAGGAAAT

GGTGGCTTTGACTCCTGGGGCCAGGGAACCCTGGTCACCGTCTCAAGC 129. 806C-M0062-E02
L-Variable (AA):
QSVLTQPASVSGSPGQSITISCTGTSSDVGSYNLVSWYQQHPGKAPKLMIYEGSKRPSGVSNRFS  (SEQ ID NO: 676)

GSKSGNTASLTISGLQAEDEADYYCCSYAGSSTYVFGTGTKVTVL

L-Variable (DNA):
CAGAGCGTCTTGACTCAGCCTGCCTCCGTGTCTGGGTCTCCTGGACAGTCGATCACCATCTCCTG  (SEQ ID NO: 677)

CACTGGAACCAGCAGTGATGTTGGGAGTTATAACCTTGTCTCCTGGTACCAACAGCACCCAGGCA

AAGCCCCCAAACTCATGATT

TATGAGGGCAGTAAGCGGCCCTCAGGGGTTTCTAATCGCTTCTCTGGCTCCAAGTCTGGCAACAC

GGCCTCCCTGACAATCTCTGGGCTCCAGGCTGAGGACGAGGCTGATTATTACTGCTGCTCATATG

CAGGTAGTAGCACTTATGTC

TTCGGAACTGGGACCAAGGTCACCGTCCTA

H-Variable (AA):
EVQLLESGGGLVQPGGSLRLSCAASGFTFSHYVMSWVRQAPGKGLEWVSVIYPSGGWTGYADSVK  (SEQ ID NO: 678)

GRFTISRDNSKNTLYLQMNSLRAEDTAVYYCARGVATTSFDYWGQGTLVTVSS

H-Variable (DNA):
GAAGTTCAATTGTTAGAGTCTGGTGGCGGTCTTGTTCAGCCTGGTGGTTCTTTACGTCTTTCTTG  (SEQ ID NO: 679)

CGCTGCTTCCGGATTCACTTTCTCTCATTACGTTATGTCTTGGGTTCGCCAAGCTCCTGGTAAAG

GTTTGGAGTGGGTTTCTGTT

ATCTATCCTTCTGGTGGCTGGACTGGTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGGGGTG

GCAACTACTAGTTTTGACTACTGGGGCCAGGGAACCCTGGTCACCGTCTCAAGC 130. 806C-M0062-E03
L-Variable (AA):
QDIQMTQSPATLSLSPGERATLSCRASQSVSSYLAWYQQKPGQAPRLLIYDASNRATGIPARFSG (SEQ ID NO: 680)

SGSGTDFTLTISSLEPEDFAVYYCQQRSNWPRSITFGQGTRLEIK

L-Variable (DNA):
CAAGACATCCAGATGACCCAGTCTCCAGCCACCCTGTCTTTGTCTCCAGGGGAAAGAGCCACCCT (SEQ ID NO: 681)

CTCCTGCAGGGCCAGTCAGAGTGTTAGCAGCTACTTAGCCTGGTACCAACAGAAACCTGGCCAGG

CTCCCAGGCTCCTCATCTAT

GATGCATCCAACAGGGCCACTGGCATCCCAGCCAGGTTCAGTGGCAGTGGGTCTGGGACAGACTT

CACTCTCACCATCAGCAGCCTAGAGCCTGAAGATTTTGCAGTTTATTACTGTCAGCAGCGTAGCA

ACTGGCCTCGATCGATCACC

TTCGGCCAAGGGACACGACTGGAGATTAAA

H-Variable (AA):
EVQLLESGGGLVQPGGSLRLSCAASGFTFSRYLMRWVRQAPGKGLEWVSGIYPSGGITAYADSVK (SEQ ID NO: 682)

GRFTISRDNSKNTLYLQMNSLRAEDTAVYYCARASGSYYNYYFDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 683)

CGCTGCTTCCGGATTCACTTTCTCTCGTTACCTTATGCGTTGGGTTCGCCAAGCTCCTGGTAAAG

GTTTGGAGTGGGTTTCTGGT

ATCTATCCTTCTGGTGGCATTACTGCTTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGCTTCG

GGGAGTTATTATAATTACTACTTTGACTACTGGGGCCAGGGCACCCTGGTCACCGTCTCAAGC 131. 806C-M0062-E11
L-Variable (AA):
QDIQMTQSPSSLSASVGDRVAITCRASQSIDTYLNWYQHKPGKAPKLLIYAASKLEDGVPSRFSG (SEQ ID NO: 684)

SGTGTDFTLTIRSLQPEDFASYFCQQSYSSPGITFGPGTKVEIK

L-Variable (DNA):
CAAGACATCCAGATGACCCAGTCTCCATCCTCCCTGTCTGCATCTGTGGGAGACAGAGTCGCCAT (SEQ ID NO: 685)

CACTTGCCGCGCAAGTCAGAGCATCGACACCTATTTAAATTGGTATCAGCACAAACCAGGGAAAG

CCCCTAAACTCCTGATCTAT

GCTGCATCCAAGTTGGAAGACGGGGTCCCATCAAGATTCAGTGGCAGTGGAACTGGGACAGATTT

CACTCTCACCATCAGAAGTCTGCAACCTGAAGATTTTGCAAGTTATTTCTGTCAACAGAGCTACT

CTAGTCCAGGGATCACTTTC

GGCCCTGGGACCAAGGTGGAGATCAAA

H-Variable (AA):
EVQLLESGGGLVQPGGSLRLSCAASGFTFSAYVMHWVRQAPGKGLEWVSRIYPSGGITYYADSVK (SEQ ID NO: 686)

GRFTISRDNSKNTLYLQMNSLRAEDTAVYYCARGILTGPNYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 687)

CGCTGCTTCCGGATTCACTTTCTCTGCTTACGTTATGCATTGGGTTCGCCAAGCTCCTGGTAAAG

GTTTGGAGTGGGTTTCTCGT

ATCTATCCTTCTGGTGGCATTACTTATTATGCTGACTCCGTTAAAGGTCGCTTCACTATCTCTAG

```
AGACAACTCTAAGAATACTCTCTACTTGCAGATGAACAGCTTAAGGGCTGAGGACACGGCCGTGT

ATTACTGTGCGAGAGGGATT

TTGACTGGCCCAAACTACTGGGGCCAGGGAACCCTGGTCACCGTCTCAAGC
```

132. 806C-M0062-F10
L-Variable (AA):
QSALTQSPSASASLGASVKLTCSLSSGHSSYAIAWHQQQPEKGPQYLMKVNSDGSHTKGDGIPDR (SEQ ID NO: 688)

FSGSSSGAERYLTISSLQSEDEADYYCQTWGTGSWVFGGGTKLTVL

L-Variable (DNA):
CAGAGCGCTTTGACTCAATCGCCCTCTGCCTCTGCCTCCCTGGGAGCCTCGGTCAAGCTCACCTG (SEQ ID NO: 689)

CAGTCTGAGCAGTGGGCACAGCAGCTACGCCATCGCATGGCATCAGCAGCAGCCAGAGAAGGGCC

CCCAGTACTTAATGAAGGTTAACAGTGATGGCAGCCACACCAAGGGGGACGGGATCCCTGATCGC

TTCTCAGGCTCCAGCTCTGGGGCTGAGCGCTACCTCACCATCTCCAGCCTCCAGTCTGAGGATGA

GGCTGACTATTACTGTCAGACCTGGGGCACTGGCTCTTGGGTGTTCGGCGGAGGGACCAAGCTGA

CCGTCCTA

H-Variable (AA):
EVQLLESGGGLVQPGGSLRLSCAASGFTFSRYKMSWVRQAPGKGLEWVSYIYPSGGHTEYADSVK (SEQ ID NO: 690)

GRFTISRDNSKNTLYLQMNSLRAEDTAVYYCAREREGTPDYWGQGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 691)

CGCTGCTTCCGGATTCACTTTCTCTCGTTACAAGATGTCTTGGGTTCGCCAAGCTCCTGGTAAAG

GTTTGGAGTGGGTTTCTTAT

ATCTATCCTTCTGGTGGCCATACTGAGTATGCTGACTCCGTTAAAGGTCGCTTCACTATCTCTAG

AGACAACTCTAAGAATACTCTCTACTTGCAGATGAACAGCTTAAGGGCTGAGGACACGGCCGTGT

ATTACTGTGCGAGAGAAAGG

GAAGGGACCCCTGACTACTGGGGCCAGGGAACCCTGGTCACCGTCTCAAGC 133. 806C-M0062-G06
L-Variable (AA):
QSVLTQPASVSGSPGQSITISCTGTSSDDVGGYNYVSWYQQHPGKAPKLLIYDVINRPSGVSNRF (SEQ ID NO: 692)

SGSKSGNTASLTISGLQAEDEADYYCSSYASSGARVFGTGTKVTVL

L-Variable (DNA):
CAGAGCGTCTTGACTCAGCCTGCCTCCGTGTCTGGGTCTCCTGGACAGTCGATCACCATCTCCTG (SEQ ID NO: 693)

CACTGGAACCAGCAGTGACGACGTTGGTGGTTATAACTATGTCTCCTGGTACCAACAACACCCAG

GCAAAGCCCCCAAACTCCTG

ATTTATGATGTCATTAATCGGCCCTCAGGAGTTTCTAATCGCTTCTCTGGGTCCAAGTCTGGCAA

CACGGCCTCCCTGACCATCTCTGGGCTCCAGGCTGAGGACGAGGCTGATTATTACTGCAGCTCAT

ATGCAAGCAGCGGCGCTCGA

GTCTTCGGAACTGGGACCAAGGTCACCGTCCTA

H-Variable (AA):
EVQLLESGGGLVQPGGSLRLSCAASGFTFSIYPMIWVRQAPGKGLEWVSVIYPSGGHTRYADSVK (SEQ ID NO: 694)

GRFTISRDNSKNTLYLQMNSLRAEDTAVYYCTRRVYSSGSAYFDLWGRGTLVTVSS

H-Variable (DNA):
GAAGTTCAATTGTTAGAGTCTGGTGGCGGTCTTGTTCAGCCTGGTGGTTCTTTACGTCTTTCTTG (SEQ ID NO: 695)

CGCTGCTTCCGGATTCACTTTCTCTATTTACCCTATGATTTGGGTTCGCCAAGCTCCTGGTAAAG

GTTTGGAGTGGGTTTCTGTTATCTATCCTTCTGGTGGCCATACTCGTTATGCTGACTCCGTTAAA

GGTCGCTTCACTATCTCTAGAGACAACTCTAAGAATACTCTCTACTTGCAGATGAACAGCTTAAG

-continued

```
GGCTGAGGACACAGCCGTGTATTACTGTACGAGACGGGTATATAGTAGTGGTTCTGCGTACTTCG

ATCTCTGGGGCCGTGGCACCCTGGTCACCGTCTCAAGC 134. 806C-M0062-H01
L-Variable (AA):
QDIQMTQSPSTLSASVGDRVTITCRASQSVAGLLAWFQQKPGKAPKLLISKASILETGVPSRFSG    (SEQ ID NO: 696)

SGSGTEFTLTITSLQPDDFATYYCQQYSFNSGTFGQGTRVEMK

L-Variable (DNA):
CAAGACATCCAGATGACCCAGTCTCCTTCCACCCTGTCTGCATCTGTGGGAGACAGAGTCACCAT    (SEQ ID NO: 697)

CACCTGCCGGGCCAGCCAGAGTGTTGCTGGCTTGTTGGCCTGGTTTCAGCAGAAACCGGGCAAAG

CCCCTAAACTCCTCATCTCTAAGGCGTCTATTTTAGAGACTGGGGTCCCATCAAGGTTCAGCGGC

AGTGGATCTGGGACAGAATTCACTCTCACCATCACCAGCCTGCAGCCTGATGATTTCGCAACTTA

TTACTGCCAACAATATAGTTTCAATTCTGGGACATTCGGCCAAGGGACCAGGGTGGAAATGAAA

H-Variable (AA):
EVQLLESGGGLVQPGGSLRLSCAASGFTFSMYKMAWVRQAPGKGLEWVSYIYPSGGYTYYADSVK    (SEQ ID NO: 698)

GRFTISRDNSKNTLYLQMNSLRAEDTALYYCARVRDSAFDIWGQGTMVTVSS

H-Variable (DNA):
GAAGTTCAATTGTTAGAGTCTGGTGGCGGTCTTGTTCAGCCTGGTGGTTCTTTACGTCTTTCTTG   (SEQ ID NO: 699)

CGCTGCTTCCGGATTCACTTTCTCTATGTACAAGATGGCTTGGGTTCGCCAAGCTCCTGGTAAAG

GTTTGGAGTGGGTTTCTTATATCTATCCTTCTGGTGGCTATACTTATTATGCTGACTCCGTTAAA

GGTCGCTTCACTATCTCTAGAGACAACTCTAAGAATACTCTCTACTTGCAGATGAACAGCTTAAG

GGCTGAGGACACCGCCTTGTATTACTGTGCGAGAGTAAGGGATTCCGCTTTTGATATCTGGGCC

AAGGGACAATGGTCACCGTCTCAAGC
```

Example 29

Exemplary Tie1 Antibodies

Tables 5 (FIG. 37) and 6 (FIG. 38) list CDR regions of exemplary light and heavy chain variable regions which are listed herein. FIG. 39 (Table 9) list properties of some of the exemplary antibodies Some antibodies described herein include related variable domains. The same variable domain can function with a different partner variable domain. For example, M0044-G06 and M0044-B05 share a HC variable domain, but have different LC variable domains, as do M0044-G07 and M0044-B05. Other antibodies that have the same HC variable domain include: HC 54(M0053-D12) and 19(M0044-H05); HC 59(M0053-F05) and 19(M0044-H05); HC 72(M0054-H10) and 25(M0045-B03); and HC 98(M0056-F11) and 57(M0053-E08). Some antibodies that have the same LC variable domain include: LC 114(M0059-A06) and 106 (M0057-H07); LC 130(M0062-E11) and 106(M0057-H07); and LC 115(M0060-B02) and 12(M0044-F03). Some antibodies have the same CDR3. For example, the CDR3 sequence, QGGGGRAFDI, is present in M0056-C04 and M0056-F02. The CDR3 sequence IAGGAYHLDY is present in M0056-E08 and M0061-C05.

In some cases, an antibody can include a non-germline residue. One or more of such non-germline residues can be modified, e.g., to restore the germline residue. Exemplary non-germline residues include: L45F (see, e.g., M0053-D06); V48F (see, e.g., M0062-C08); delta S53 (see, e.g., M0045-B01; M0047-D03; M0055-D12; M0061-A03); delta G54 (see, e.g., M0053-A03); T57I (see, e.g., M0046-B10); E85D (see, e.g., M0056-H12); T87M (see, e.g., M0053-F06; M0055-E12; M0056-B08); V89L (see, e.g., M0044-B08; M0047-D01; M0060-B02; M0062-H01); V89M (see, e.g., M0044-B10; M0045-C12; M0045-D07; M0053-B11; M0055-B12; M0055-E06; M0056-A01; M0056-G12; M0058-G03; M0059-A06; M0060-H01; M0061-F07); V89T (see, e.g., M0044-H07; M0046-A11; M0046-B10; M0047-D03; M0055-C07; M0055-D03; M0055-G02); A93T (see, e.g., M0045-A02; M0053-F08; M0056-H12; M0058-E09; M0059-A02; M0061-C06; M0062-G06); and T107K (see, e.g., M0045-B03).

Example 30

Sequence of DX-2220 Antibody

DX-2220 is a full length, IgG1, germlined human anti-Tie1 antibody E3b. The sequence of DX-2220 is as follows:

```
DX-2220 Light Chain Amino Acid Sequence:

DIQMTQSPSSLSASVGDRVTITCRASQGIGHYLAWYQQKPGKVPKLLIYT                    (SEQ ID NO: 700)

ASTLQSGVPSRFSGSGSGTDFTLTISSLQPEDVATYYCQQFNSYPHTFGQG
```

-continued

TRLEIKRTVAAPSVFIFPPSDEQLKSGTASVVCLLNNFYPREAKVQWKVD

NALQSGNSQESVTEQDSKDSTYSLSSTLTLSKADYEKHKVYACEVTHQG

LSSPVTKSFNRGEC

DX-2220 Heavy Chain Amino Acid Sequence:

EVQLLESGGGLVQPGGSLRLSCAASGFTFSMYGMVWVRQAPGKGLEWV    (SEQ ID NO: 701)

SVISPSGGNTGYADSVKGRFTISRDNSKNTLYLQMNSLRAEDTAVYYCAR

APRGYSYGYYYWGQGTLVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKKVEPKSCDKTHTCPPCPAPELLGGPSVFLFPPK

PKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPR

EPQVYTLPPSRDELTKNQVSLTCLVKGFYPSDIAVEWESNGQPENNYKTT

PPVLDSDGSFFLYSKLTVDKSRWQQGNVFSCSVMHEALHNHYTQKSLSL

SPGK

An exemplary DX-2220 Light Chain Nucleotide Sequence:

ggcgtgcactctgacatccagatgacccagtctccatcctccctgtctgcatctgtaggagacagagtca    (SEQ ID NO: 702)
ccatcacttgccgggcgagtcagggcattggccattatttagcctggtatcagcagaaaccagggaaagt
tcctaagctcctgatctatactgcatccactttgcaatcaggggtcccatctcggttcagtggcagtgga
tctgggacagatttcactctcaccatcagcagcctgcagcctgaagatgttgcaacttattactgtcaac
agtttaatagttaccctcacaccttcggccaagggacacgactggagattaaacgaactgtggctgcacc
atctgtcttcatcttcccgccatctgatgagcagttgaaatctggaactgcctctgttgtgtgcctgctg
aataacttctatcccagagaggccaaagtacagtggaaggtggataacgccctccaatcgggtaactccc
aggagagtgtcacagagcaggacagcaaggacagcacctacagcctcagcagcaccctgacgctgagcaa
agcagactacgagaaacacaaagtctacgcctgcgaagtcacccatcagggcctgagctcgcccgtcaca
aagagcttcaacaggggagagtgttaataa An exemplary DX-2220 Heavy Chain Nucleotide Sequence:

gaagttcaattgttagagtctggtggcggtcttgttcagcctggtggttctttacgtctttt    (SEQ ID NO: 703)
cttgcgctgcttccggattcactttctctatgtacggtatggtttgggttcgccaagctcctggtaaagg
tttggagtgggtttctgttatctctccttctggtggcaatactggttatgctgactccgttaaaggtcgc
ttcactatctctagagacaactctaagaatactctctacttgcagatgaacagcttaagggctgaggaca
ctgcagtctactattgtgcgagagccccacgtggatacagctatggttactactactggggccagggaac
cctggtcaccgtctcaagcgcctccaccaagggcccatcggtcttccccgctagcaccctcctccaagagc
acctctgggggcacagcggccctgggctgcctggtcaaggactacttccccgaaccggtgacggtgtcgt
ggaactcaggcgccctgaccagcggcgtccacaccttcccggctgtcctacagtcctccggactctactc
cctcagcagcgtagtgaccgtgccctccagcagcttgggcacccagacctacatctgcaacgtgaatcac
aagcccagcaacaccaaggtggacaagaaagttgagcccaaatcttgtgacaaaactcacacatgcccac
cgtgcccagcacctgaactcctggggggaccgtcagtcttcctcttccccccaaaacccaaggacaccct
catgatctcccggacccctgaggtcacatgcgtggtggtggacgtgagccacgaagaccctgaggtcaag
ttcaactggtacgtggacggcgtggaggtgcataatgccaagacaaagccgcgggaggagcagtacaaca

```
-continued
gcacgtaccgtgtggtcagcgtcctcaccgtcctgcaccaggactggctgaatggcaaggagtacaagtg caaggtctccaacaaagccctcccagcccccatcgagaaaaccatctccaaagccaaagggcagccccga gaaccacaggtgtacaccctgcccccatcccgggatgagctgaccaagaaccaggtcagcctgacctgcc tggtcaaaggcttctatcccagcgacatcgccgtggagtgggagagcaatgggcagccggagaacaacta caagaccacgcctcccgtgctggactccgacggctccttcttcctctacagcaagctcaccgtggacaag agcaggtggcagcaggggaacgtcttctcatgctccgtgatgcatgaggctctgcacaaccactacacgc agaagagcctctccctgtctccgggtaaatga
```

Example 31

DX-2220 Slows Colorectal Cancer Xenograft Tumor Progression in Nude Mice

Mice (nu/nu) were implanted subcutaneously with $5 \times 10^6$ SW-480 (colorectal cancer) cells. After 12 days, when tumors reached approximately 100-200 mg, the mice were separated into 5 groups and treated with the following agents (or left untreated):

1—Untreated
2—Vehicle (PBS)
3—Cisplatin (4 mg/kg/, IV, q2d×5 times)
4—A2-SV (negative control antibody @ 10 mg/kg, IP, q2d×14 times)
5—DX-2220 (anti-Tie-1 antibody @ 10 mg/kg, IP, q2d×14 times)

Throughout the study, the length (L) and width (W) of any tumors that developed were measured in millimeters using calibrated vernier calipers, where L is the longer of the two dimensions. When applicable, tumor weight (M) in milligrams was calculated by using the formula associated with a prolate ellipsoid: $M=(L \times W^2)/2$. Table 7 shows the average weights (in mg) of the tumors for each of the groups. A2-SV is an isotype matched (IgG1) negative control antibody that binds strepavidin.

TABLE 7

| | Tumor Weight (mg) | | | | |
|---|---|---|---|---|---|
| Days after Cell Injection | Group 1 Untreated | Group 2 Vehicle | Group 3 Cisplatin | Group 4 A2-SV | Group 5 DX-2220 |
| 5 | 57 | 95 | 48 | 111 | 112 |
| 9 | 88 | 117 | 69 | 120 | 137 |
| 12 | 118 | 139 | 137 | 149 | 139 |
| 15 | 153 | 203 | 185 | 159 | 145 |
| 19 | 202 | 309 | 207 | 308 | 186 |
| 22 | 316 | 431 | 235 | 350 | 224 |
| 26 | 403 | 532 | 310 | 405 | 292 |
| 28 | 449 | 587 | 363 | 526 | 328 |

Figure 5:
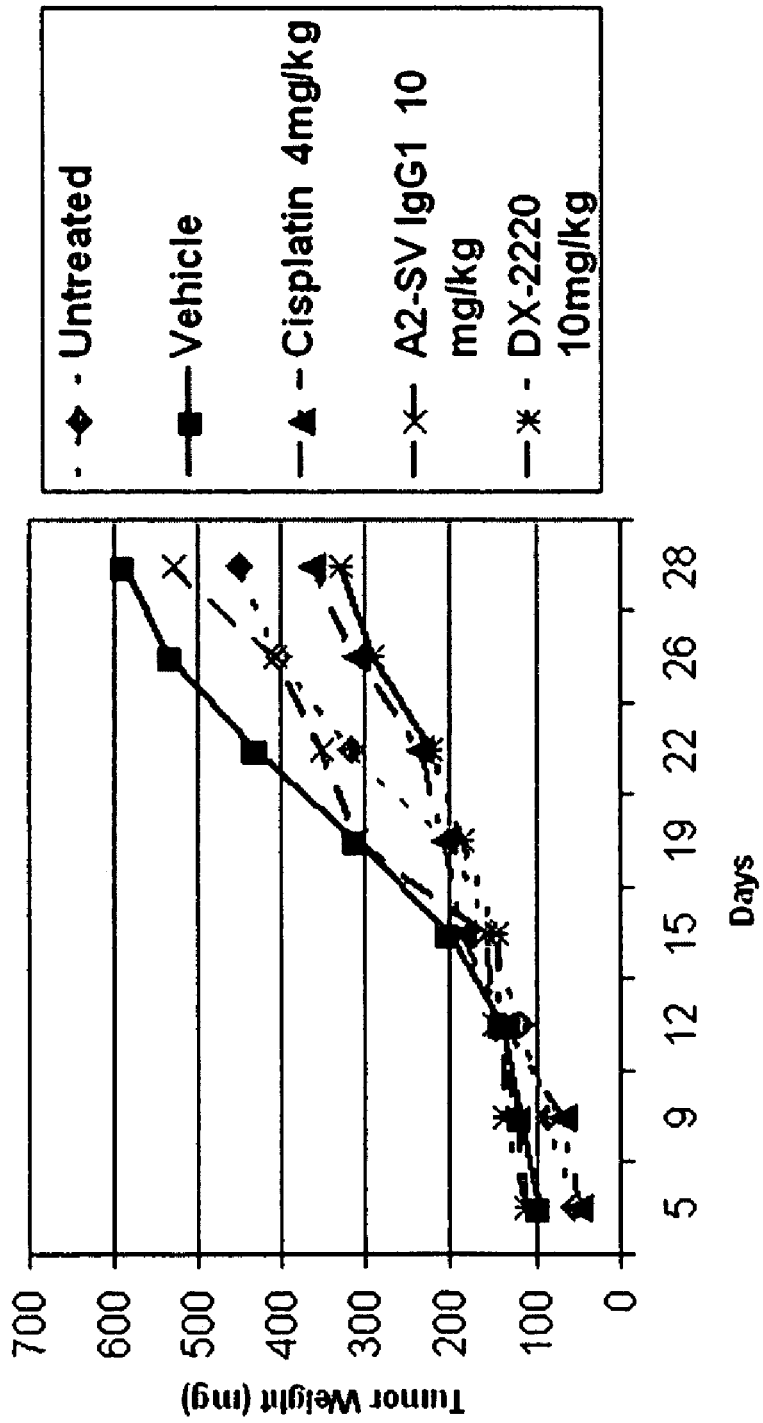
FIG. 5 depicts graphically the results from animal studies in which nu/nu mice were implanted with SW-480 colorectal cancer cells and treated with DX-2220 (10 mg/kg), cisplatin (4 mg/kg), or a control. Control conditions were: no treatment, PBS vehicle alone, or a non-specific, isotype-matched IgG1 antibody (A2-SV) (10 mg/kg). Tumor weight is plotted on the y axis; days after tumor cell injection is plotted on the x axis.

The results from the animal study shown in Table 7 are depicted graphically in FIG. 5. DX-2220 slowed tumor progression by 44% when compared to vehicle (PBS)-treated control animals. In addition, DX-2220 was as efficacious as the chemotherapeutic control (cisplatin).

Example 32

Production and Testing of Germlined Anti Tie1 E3 Fab and IgG for Binding to Human and Mouse Tie1 in BIACore Expression and Purification. Fabs were produced in the *E. coli* strain, TG1, using an expression vector containing a PelB leader sequence for secretion into the periplasm. Under the conditions used for induction (overnight incubation at 30° C. in the presence of 1 mM IPTG), the majority of the secreted Fab was localized in the culture medium rather than the periplasm. The secreted Fab was recovered by adding protein A resin to the clarified culture medium. This protein A resin was then packed into a column to facilitate washing, with PBS, and elution with 50 mM sodium phosphate, 150 mM NaCl, pH 2.5. The pH was brought to approximately neutral by addition of one half volume of 1 M HEPES before buffer exchange into PBS The concentration of the purified germlined E3 (DX-2220) Fab was determined using $OD_{280}$ 1.4=1.0 mg/ml.

The IgG was produced transiently in HEK293T cells using either LIPOFECTAMINE™ 2000 or GENEJUICE™ as the transfection reagent. Antibody could be produced from cells harvested at 72, 144, and 216 hours post transfection. Purification of the IgG from the conditioned culture media essentially followed the same protocol outlined above for the Fab purification. The concentration of the purified IgG was determined using $OD_{280}$ 1.4=1.0 mg/ml.

For preclinical animal studies, IgG were purified using a two-step purification procedure, initially with protein A chromatography subsequently followed by ion exchange chromatography (IEX). Purified IgGs were subjected to biochemical analyses to assess endotoxin levels, leached protein A, DNA content, and host cell proteins.

Biochemical Analysis

Affinity analysis of the Fab and IgGs was performed using surface plasmon resonance using a BIAcore 3000 instrument. For this analysis both dimeric (Tie1-Fc fusion protein) and monomeric (Tie1-HIS) versions of the extracellular domain of the Tie1 were used. The sensor chips used in these experiments were CM5 (dextran-coated) which allow immobilization of proteins to the chip via standard amine coupling chemistries. The concentration of flowed antibody was determined using a surface plasmon resonance based method. Using a high-density protein A sensor chip, under mass transport limited conditions, the response signal is dependent only on the concentration of the antibody in the sample under test. This approach allows a precise determination of the antibody concentration, a parameter important for accurate determination of the $K_D$.

470 RUs of Tie1 HIS protein were coated on a CM5 sensor chip and 5, 20, 100, and 500 nM of the Fab flowed over the chip at four different flow rates (10, 30, 50 and 80 μl/s), rates in which the system is not mass transport limited. Kinetic data was typically determined using a range of analyte concentrations and three different chip coating densities. The data from the lowest coating density that gave a good signal was typically chosen, this was often in a range from 50-100 RUs. Using such low coating densities allowed the sensor curves to be fit using BIAEVALUATION™ 3.0 software to a 1:1 model, often even when using a bivalent analyte (IgG or Tie1-Fc fusion protein). For bivalent analytes, when fit to a 1:1 model was not possible, the curves were fit using a 2:1 model. The generated data is shown in Table 8.

protein. In both of these experiments the Tie1-Fc fusion protein was immobilized on the sensor chip and the anti Tie-1 Fab served as the analyte. Under these experimental conditions the anti-Tie1 Fab has very similar $K_D$ (~3 nM) values for both the human and mouse Tie1-Fc fusion proteins (Table 9). Under conditions that are likely to mimic those used in the animal efficacy experiments, i.e. Tie1-Fc immobilized to the CM5 sensor chip and anti-Tie1 used as the analyte, the measured $K_D$ was 0.2 nM. This greater than 10 fold increase in affinity represents an avidity effect that results from a bivalent molecule (anti-Tie1) binding to a multivalent surface (immobilized Tie1-Fc).

Example 33

Sequence of DX-2240: Germlined F Allotyped E3 Antibody

```
DX-2240 (Light, heavy - variable, constant). Variable region:

DIQMTQSPSSLSASVGDRVTITCRASQGIGHYLAWYQQKPGKVPKLLIYTASTL            SEQ ID NO: 724

QSGVPSRFSGSGSGTDFTLTISSLQPEDVATYYCQQFNSYPHTFGQGTRLEIK                light chain RTVAAPSVFIFPPSDEQLKSGTASVVCLLNNFYPREAKVQWKVDNALQSNSQE             (variable + constant)

SVTEQDSKDSTYSLSSTLTLSKADYEKHKVYACEVTHQGLSSPVTKSFNRGEC

DX-2240 Heavy variable:

EVQLLESGGGLVQPGGSLRLSCAASGFTFSMYGMVWVRQAPGKGLEWVSVISPS

GGNTGYADSVKGRFTISRDNSKNTLYLQMNSLRAEDTAVYYCARAPRGYSYGYYYWGQG

TLVTVSS

Heavy constant (CH1, Hinge, CH2, CH3):

ASTKGPSVFPLAPSSKSTSGGTAALGCLVKDYFPEPVTVSWNSGALTSGVHTFP            SEQ ID NO: 723

AVLQSSGLYSLSSVVTVPSSSLGTQTYICNVNHKPSNTKVDKRVEPKSCDKTHTCPPCP         heavy chain

APELLGGPSVFLFPPKPKDTLMISRTPEVTCVVVDVSHEDPEVKFNWYVDGVEVHNAKT         (variable + constant)

KPREEQYNSTYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVLDSDGSFFLY

SKLTVDKSRWQQGNVFSCSVMHEALHNHYTQKSLSLSPGK
```

TABLE 8

Kinetic data for binding of DX-2220 Fab and IgG to human Tie1-Fc fusion protein

| | Human Tie1-Fc | | |
|---|---|---|---|
| Fab | $K_{on}$ (1/Ms) | $K_{off}$ (1/s) | $K_D$ (nM) |
| Fab Parental | 8.26E+03 | 4.47E−05 | 5.4 |
| Fab Germlined | 9.30E+03 | 4.41E−05 | 4.7 |
| IgG Parental | 6.19E+03 | 3.61E−05 | 5.8 |
| IgG Germlined | 7.09E+03 | 3.67E−05 | 5.2 |

The anti-Tie1 antibodies described here bind to both human and mouse Tie1 molecules. The binding of the anti-Tie1 Fab to mouse Tie1-Fc fusion protein was compared with the binding of the anti-Tie1 Fab to human Tie1-Fc fusion The light chain can optionally further include the following signal sequence: Light signal sequence: MGWSCIIL-FLVATATGVHS (SEQ ID NO:720). The heavy chain can optionally further include the following signal sequence MGWSCIILFLVATATGAHS (SEQ ID NO:721).

Example 34

Characterization of DX-2240 from a GS-CHO Cell Line

The anti-Tie1 antibody DX-2240 (light and heavy chain germlined and f-allotype) antibodies was produced in HEK293T cells. A stable CHO cell line expressing DX-2240 was generated. Using standard molecular biology cloning techniques, the light and heavy chains from DX-2240 was inserted into glutamine synthase (GS) vector system available from Lonza Group Ltd. CH (see, e.g., Clark et al. (2004) BioProcess International 2(4):48-52; Barnes et al. (2002)

Biotech Bioeng. 81(6):631-639). The single vector constructs containing the light and heavy chains respectively, were then combined to create a single, double gene vector. This DNA construct was then used to generate stable CHO cell lines, grown under MSX selection pressure. One of these clones was then expanded and a single 40 L stirred bioreactor seeded and run over the course of 12 days. Following the completion of this run, 36 liters of clarified CHO culture supernatant was loaded onto a 200 ml Protein A XK50 column. The column was first washed with PBS pH 7.4, followed by a PBS+0.4M NaCl pH 7.4 wash, and then with a final wash of PBS pH 7.4 prior to the low pH elutions. DX-2240 IgG1 was eluted first with 0.1M NaCitrate pH 3.5 followed by the same buffer at pH 3.0. A sharp protein peak eluted at pH 3.0. The pH 3.0 elution contained a predominant peak representing DX-2240, with a low level of contaminants eluting shortly thereafter. A high degree of purity (>95%) of DX-2240 was obtained.

Example 35

Sequence Optimization of Nucleic Acid Encoding DX-2240 Antibody

To improve expression of DX-2240 in CHO cells, a synthetic gene with optimized codons and sequences was engineered. The strategies include codon optimization, CpG island and splice site analysis. An optimized DX-2240 sequence has been synthesized and reformatted into the glutamine synthase (GS) vector system. The exemplary codon optimized sequence is as follows:

```
DX-2240-heavy chain (SEQ ID NO: 725)

Signal sequence
            ATGGGCTGGTCCTGTATCATCCTGTTTCTGGTGGCCACCGCCACCGGCGCTCACTCT

GAGGTGCAGCTGCTGGAGTCTGGCGGCGGACTGGTGCAGCCTGGCGGCTCTCTGAGA

CTGTCTTGTGCCGCCTCCGGCTTCACCTTCTCC ATGTACGGCATGGTG TGGGTGAGGCAG

GCCCCTGGCAAGGGCCTGGAGTGGGTGTCC GTGATCTCTCCTTCTGGCGGCAATACCGGC

TACGCCGACTCTGTGAAGGGC CGGTTCACCATCTCCCGGGACAACTCCAAGAACACCCTG

TACCTGCAGATGAACTCCCTGAGAGCCGAGGATACCGCCGTGTACTACTGTGCCAGA GCC

CCTAGAGGCTACTCCTACGGCTACTACTAC TGGGGCCAGGGCACCCTGGTGACCGTGTCC

TCTGCTTCTACCAAGGGCCCTTCCGTGTTTCCTCT GGCCCCTTCCTCCAAGTCTACCTCT

GGCGGCACCGCCGCTCTGGGCTGCCTGGTGAAGGACTACTTCCCTGAGCCCGTGACAGTG

TCCTGGAACTCTGGCGCCCTGACCTCCGGCGTGCACACCTTCCCTGCTGTGCTGCAGTCC

TCCGGCCTGTACTCTCTGTCCTCCGTGGTGACAGTGCCTTCCTCTTCTCTGGGCACCCAG

ACCTACATCTGTAACGTGAACCACAAGCCCTCCAACACCAAGGTGGACAAGCGGGTGGAG

CCTAAGTCCTGTGACAAGACCCACACCTGCCCTCCTTGTCCTGCCCCTGAGCTGCTGGGC

GGACCTTCTGTGTTCCTGTTCCCCCCCAAGCCTAAGGACACCCTGATGATCTCCAGGACC

CCTGAGGTGACCTGTGTGGTGGTGGACGTGTCTCACGAGGATCCCGAGGTGAAGTTCAAC

TGGTACGTGGACGGCGTGGAGGTGCACAACGCCAAGACCAAGCCTAGGGAGGAGCAGTAC

AACTCCACCTACCGGGTGGTGTCTGTGCTGACCGTGCTGCACCAGGATTGGCTGAACGGC

AAGGAGTACAAGTGTAAGGTGTCCAACAAGGCCCTGCCTGCCCCTATCGAAAAGACCATC

TCCAAGGCCAAGGGCCAGCCTAGAGAGCCTCAGGTGTACACCCTGCCTCCTTCCAGGGAG

GAGATGACCAAGAACCAGGTGTCCCTGACCTGTCTGGTGAAGGGCTTCTACCCTTCCGAT

ATCGCCGTGGAGTGGGAGTCTAATGGCCAGCCCGAGAACAACTACAAGACCACCCCTCCT

GTGCTGGACTCTGACGGCTCCTTCTTCCTGTACTCCAAGCTGACCGTGGACAAGTCCAGA

TGGCAGCAGGGCAACGTGTTCTCCTGCTCCGTGATGCACGAGGCCCTGCACAATCACTAC

ACCCAGAAGTCCCTGTCTCTGTCCCCCGGCAAGTGATGAGAATTC

DX-2240 Light chain (SEQ ID NO: 726):

Signal sequence
            ATGGGCTGGTCCTGTATCATCCTGTTTCTGGTGGCCACCGCCACCGGCGTGCACTCT

GACATCCAGATGACCCAGTCCCCTTCCTCTCTGTCTGCCTCTGTGGGCGACAGAGTGACCATCAC

CTGTAGAGCCTCTCAGGGCATCGGCCACTACCTGGCCTGGTATCAGCAGAAGCCTGGCAAGGTGCCCAAGC
```

-continued

```
TGCTGATCTACACCGCCTCCACCCTGCAGTCTGGCGTGCCTTCCAGATTCTCCGGCTCTGGCTCTGGCACC

GATTTCACCCTGACCATCTCCTCCCTGCAGCCTGAGGATGTGGCCACCTACTACTGC

CAGCAGTTCAACTCCTACCCCCACACC TTCGGCCAGGGCACCAGACTGGAGATCAAG

AGAACCGTGGCCGCTCCTTCCGTGTTCATCTTCCCCCCTTCCGACGAGCAGCTGAAGTCTGGCACCGCCTC

TGTGGTGTGTCTGCTGAACAACTTCTACCCCCGGGAGGCCAAGGTGCAGTGGAAGGTGGACAACGCCCTGC

AGTCCGGCAATTCCCAGGAGTCTGTGACCGAGCAGGACTCCAAGGACAGCACCTACTCCCTGTCCTCTACC

CTGACCCTGTCCAAGGCCGACTACGAGAAGCACAAGGTGTACGCCTGTGAGGTGACCCACCAGGGCCTGTC

CTCTCCTGTGACCAAGTCCTTCAACCGGGGCGAGTGCTGATGAGAATTC
```

Example 36

Pharmacokinetic and Biodistribution Studies in Mice

The in vivo pharmacokinetics and stability of DX-2240 (produced in HEK293T cells) was determined by iodinating the protein on available tyrosine residues and measuring plasma clearance and stability in mice after a single intravenous dose. Samples were radio-iodinated by the indirect method using the IODO-GEN™ reagent (method from Pierce, and described by Chizzonite et al. ((1991) *J. Immunol.* 147:1548; (1992) *J. Immunol.* 148: 3117). Samples were incubated with the $^{125}$I-NaI solution for 9 min at which time tyrosine (10 mg/mL, a saturated solution) was added to quench the reaction. After about 15 min a 5 µl aliquot was removed as a standard for counting. For each labeling reaction, the $^{125}$I-labeled material (approx. 0.6 mL) was purified using a single 5 mL D-salt 1800 polyacrylamide column (Pierce). Columns were washed with 25 mM Tris, 0.4 M NaCl, pH 7.5 containing 2.5% HSA to block nonspecific sites then extensively with the same buffer minus the HSA. Samples were applied in and columns were eluted with a series of 0.3 mL aliquots. Recovery of applied activity in all protein fractions was >75% and the total recovery of applied activity was >90%. The fractions containing peak levels of labeled protein were pooled for animal injections. To prepare the injectate, the pool was diluted with Tris buffer (pH 7.5) so that the 100 µl injection volume contained about 10 µg of labeled material.

Solutions containing the radio-labeled compounds were administered to all mice by injection into the tail vein. At predetermined times post-administration animals were sacrificed and blood samples were taken for analyses. Time points tested after injection of radio-labeled compounds were: approximately 0, 7, 15, 30 and 90 minutes, 4 h, 8 h, 16 h, 24 h, 48 h and 72 h after injection. Four animals were sacrificed for each time point. At sacrifice, 0.5 mL aliquots of blood were collected into anticoagulant (0.02 mL EDTA) tubes. Plasma was separated from cells by centrifugation and the plasma fraction was divided into two aliquots, one frozen and one stored at 4° C. for immediate analysis.

Analyses included gamma counting of all samples. In this single dose i.v. study, DX-2240 exhibited a relatively short-half life in mice of less than 5 hours. Analysis of the biodistribution of DX-2240 in these mice revealed some accumulation of this antibody, at 30 minutes, in the lungs (12.85% ID/g), spleen (7.44% ID/g), kidney (8.34% ID/g), liver (5.42% ID/g) and heart (4.04% ID/g). DX-2240, due to its interaction with Tie1 on the surface of endothelial cells, may accumulate in areas of high vascularization such as the lung. Therefore, multiple administrations of DX-2240 may be required to achieve an effective steady-state level of this antibody in the serum of mice. ELISA on ocular bleeds following three every other day dosings, as well as terminal bleed samples from tumor-bearing mice treated with DX-2220, were performed. In each case, levels of DX-2220 in the serum averaged 500 µg/ml, suggesting that despite a short serum half-life in mice, an effective steady-state level of this antibody can be achieved following just three doses of DX-2220.

In addition, SEC-HPLC analysis of plasma samples to assess the in vivo stability of DX-2240 was performed. Instability of DX-2240 in mouse could have contributed to the fast clearance of this compound from the serum. SEC-HPLC analysis was performed for two plasma samples at time points at 0 min, 30 min, 90 min, 24 h and 72 h. The analysis of the radio-labeled DX-2240 showed that this compound is stable in vivo both to degradation and to interactions with plasma components. Therefore, the relatively rapid half-life of DX-2240 in mice is not due to degradation of this compound.

Example 37

DX-2220 Slows Lung Cancer Xenograft Tumor Progression in Nude Mice

The effect of DX-2220 on tumor growth in mice bearing human LNM35 lung cancer xenografts was tested. For these studies, LNM35 cells were injected subcutaneously in the lateral thorax of athymic nude mice. Four days after tumor cell implantation, treatment was initiated with DX-2220 or A2-SV (negative control antibody) at a dosage of 20 mg/kg, three times a week. Tumor sizes were measured at day 6, 8 and 10 post antibody treatment.

Figure 6:
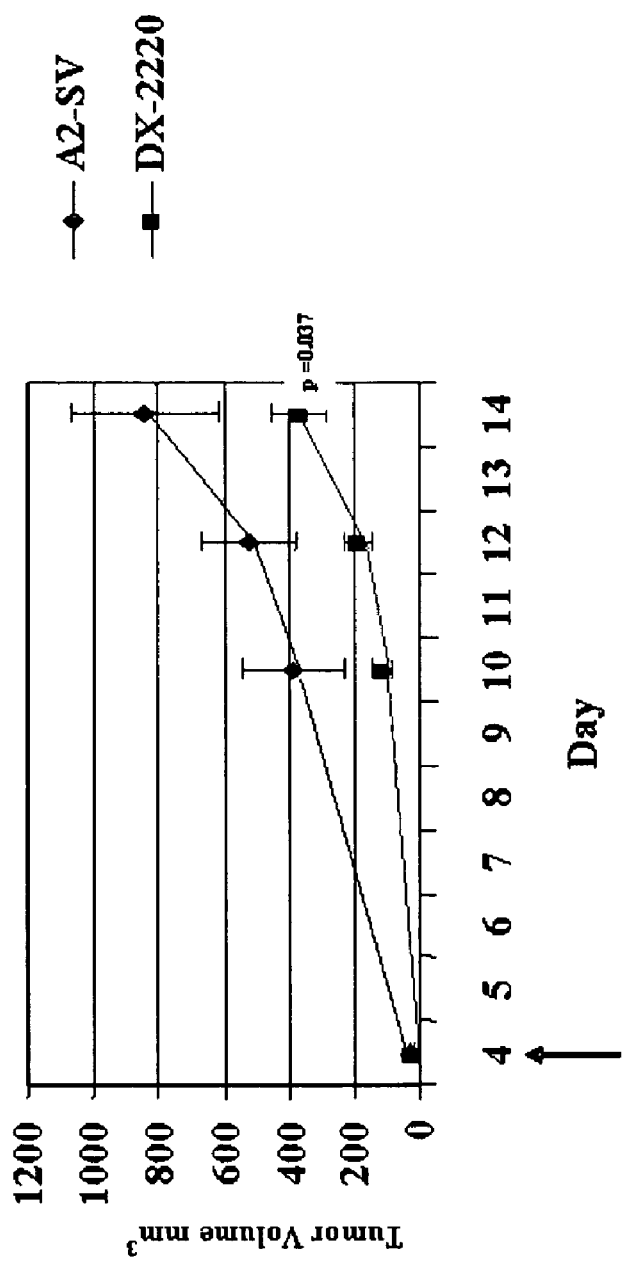
FIG. 6 depicts graphically the results from animal studies in which nu/nu mice were implanted with LNM35 lung cancer cells and treated with DX-2220 (20 mg/kg) or a non-specific, isotype-matched IgG1 antibody (A2-SV) (20 mg/kg). Tumor volume ($mm^3$) is plotted on the y axis; days after tumor cell injection is plotted on the x axis.

As shown in FIG. 6, DX-2220 significantly slowed (~60%) tumor progression in this mouse xenograft model (p=0.037). In addition, mice treated with DX-2220 did not exhibit any significant loss in body weight. These data coupled demonstrate that DX-2220 possesses significant tumor growth inhibitory activity in vivo.

Example 38

DX-2220 Slows Tumor Progression in Nude Mice

In addition to the in vivo studies presented above, four additional mouse xenografts studies were performed. These studies were conducted either according to the protocols used in the SW-480 or LNM35 study. The results from these studies are listed below.

| | |
|---|---|
| LLC (mouse lung carcinoma) | 20% inhibition @ day 14 after start of treatment |
| PC-3 (human prostate cancer) | 24% inhibition @ day 28 after start of treatment |
| LNM35 #3 (human lung carcinoma) | 30% inhibition @ day 21 after start of treatment |
| Colo205 (human colorectal cancer) | no effect |

These results suggest that the E3 anti-Tie1 antibody has an effect on a variety of tumor types, indicating broad therapeutic applicability.

Example 39

Immunohistochemical Analysis of Normal Tissues

A series of immunohistochemical analyses on a series of non-malignant normal human tissues to assess potential areas of immunoreactivity of the E3 anti-Tie1 antibody was performed. Antibody titration experiments were conducted on both cryostat and paraformaldehyde fixed sections of select normal human tissues with biotinylated DX-2220 and an IgG isotype control antibody to determine the preferred tissue preservation conditions as well as optimal concentration of the antibody that would result in minimal background and maximal detection of signal. A concentration of 20 µg/ml for the primary antibody was selected for the study with biotinylated DX-2220 and the biotinylated IgG isotype control antibody used as the primary antibodies, and the principal detection system consisting of Streptavidin HRP with DAB as the chromagen. Tissues also were stained with the positive control antibodies (anti-CD31 and anti-vimentin) to ensure that the tissue antigens were preserved and accessible for immunohistochemical analysis. Only tissues that were positive for CD31 and vimentin staining were selected for the remainder of the study. The negative control consisted of performing the entire immunohistochemical procedure on adjacent sections in the absence of primary antibody. Slides were imaged with a DVC 1310C digital camera coupled to a Nikon microscope.

The negative control (no primary antibody) slides showed occasional faint background staining within renal tubular epithelium and occasional granulocytes, but was uniformly negative in all other cell types, including the positive control cell line (HMEC, Human Microvascular Endothelial Cells) and positive control colon cancer. The IgG isotype control antibody showed faint background staining of granulocytes, macrophages, adrenal cortex, renal tubular epithelium, fallopian tube epithelium, hepatocytes, Leydig cells, and thyroid. The positive control cell line (HMEC) and positive control colon cancer sample showed either no staining or background staining.

DX-2220 demonstrated moderate membrane staining within the HMEC cell line, and staining of macrophages, some carcinoma cells, and endothelial cells within the colon cancer positive control samples. Within normal tissues, the antibody showed faint to moderate staining of macrophages, microglia in the brain, squamous epithelium of the cervix, faint staining of skeletal muscle, islets of Langerhans, and placental endothelium. These observations are consistent with low level expression of Tie1 in some endothelial, hematopoietic and epithelial tissues, as anticipated from previous reports. The islets of Langerhans staining were unexpected and should be investigated further. Most other faint staining was similar to that seen with the IgG isotype control.

If the background from the IgG isotype control is subtracted from the analysis of DX-2220, the majority of tissues were negative, including adrenal, bladder, blood, bone marrow, neurons, breast, colon, endothelium, eye, fallopian tube, heart, kidney, liver, lung, lymphocytes, ovary, exocrine pancreas, pituitary, prostate, skin, spinal cord, spleen, seminiferous epithelium of the testis, thymic lymphocytes, ureter, and uterus.

Example 40

Platelet Studies

It has been reported that Tie1 is expressed on platelets (Tsiamis et al. (2000) *J. Vasc. Res.* 37(6):437). The possibility of platelet immunoreactivity with the E3 anti-Tie1 antibody was investigated by FACs analysis and immunoprecipitation studies. DX-2200 did not show significant binding to platelets, nor did it immunoprecipitate Tie1 from platelet extracts. In addition, the effect of DX-2200 and DX-2210 on platelet agglutination and aggregation was investigated. Ristocetin, a cofactor that induces platelet agglutination by mediating the binding of von Willebrand factor (vWF) to platelet membrane glycoprotein GPIb (CD42), was used as a positive control for platelet agglutination. Antibodies to CD9 were used as a positive control to activate platelets and induce platelet aggregation, with kinetics and extent comparable to physiological agonists such as thrombin (reference). Neither the DX-2200 nor its light chain germlined variant DX-2210 induced platelet agglutination or aggregation.

Example 41

Chord Blood Stem Cell Studies

To evaluate the binding characteristics to blood progenitor cells (stem cells), FACS analysis with the anti-Tie1 antibody (or the appropriate negative control antibody) on G-CSF mobilized peripheral blood cells and with bone marrow cells was performed. Briefly, cells were blocked with 10% heat-inactivated human AB serum/2% mouse serum. Binding was initiated with biotinylated DX-2220 or biotinylated A2 negative control antibody. After washing the cells, primary antibodies were detected using FITC-labeled streptavidin. Following an additional 30 minute incubation period, remaining erythrocytes were lysed, and the resulting cell pellet after centrifugation was resuspended in PBS prior to FACS analysis. Data acquisition was performed on a FACSCanto™ (Becton-Dickinson) using FacsDiva™ software. Active gating on SSC/CD45 was used. Progenitor cells were gated on $CD45^+$ $CD34^+$ cells and were acquired automatically with at least 100,000 $CD45^+$ $CD34^+$ counted.

While the expression of Tie1 has been reported on certain hematopoietic malignancies, this experiment demonstrated that neither the negative control IgG A02, nor the E3 anti-Tie1 antibody DX-2220, positively stained $CD45^+$ $CD34^+$ blood progenitor cells. This finding supports the hypothesis that targeting Tie1 with E3 should have no deleterious effects on stem cells, unlike certain chemotherapeutic agents.

Example 42

In Vitro Hematopoiesis Studies

The effect of anti-Tie1 antibodies (DX-2220 and DX-2240) on human myeloid and erythroid progenitors was evaluated using methylcellulose-based in vitro colony assays and megakaryocyte progenitors using collagen-based in vitro assays. Neither DX-2220 nor DX-2240 inhibited colony formation in the particular conditions of this in vitro assay at concentrations up to 100 µg/ml.

The effect of the E3 anti-Tie1 antibody DX-2240 on the recovery of the mouse hematopoietic system using an in vivo myeloablation model was evaluated. Mice were injected with 5-FU on day 0 and then received either DX-2240 or a negative control antibody. At various time points following injection (days 2, 4, 6, 8, 10, 12 and 14), 4 mice were sacrificed from control and treated groups and peripheral blood and femurs were harvested. The peripheral blood and femoral cells were analyzed to determine the following:

Total nucleated cells per femur
Frequency of bone marrow colony forming cells for both myeloid and erythroid progenitors
Total hematopoietic CFC per femur
Total megakaryocytic CFC per femur
Total white blood cell count and differential analysis of mature cells DX-2240 had no effect on the recovery of the mouse hematopoietic system following 5-FU administration. This supports the in vitro findings that DX-2240 possesses no hematological toxicities under these assay conditions. Thus, it is particularly useful as a therapeutic as it will not interfere with normal hematopoietic functions required to maintain red cell and lymphocyte production.

The anti-Tie1 antibody was also evaluated for its effect on implanted tumors. Tumor cells were injected subcutaneously into the abdominal region of mice (Balb/C nu/nu female mice, 5-6 weeks old). The following tumor cells were tested: a lung carcinoma (mouse syngeneic Lewis lung carcinoma (LLC)); human lung carcinoma LNM35; an aggressive human colon carcinoma clone (SW480R). Treatments with anti-Tie1 antibody were initiated 4-6 days post-implantation. The anti-Tie1 antibodies or a control antibody (the A2 anti-streptavidin antibody) were administered intraperitoneally at 20 mg/kg every second day. Tumor volume was measured every second day and calculated as 0.5×height×width×depth.

The E3 anti-Tie1 antibody (also termed DX-2240) inhibits primary tumor growth of LLC (about a 20% effect, p=0.078; ANOVA, single factor test) and LNM35. In one study, this anti-Tie1 antibody inhibited primary tumor growth by 60% (most responsive). (Doubling of the antibody dose with administration only twice a week rather than every second day resulted in only a modest effect on primary tumor growth). The SW480R tumor was not responsive to the antibody treatment under these conditions. As described in Example 34, the antibody was effective for inhibiting tumor growth of SW480 cells (i.e., rather than the derivative SW480R cells).

Histological analysis of tumor sections from the experiment in which 60% inhibition was observed indicated that blood vessels in anti-Tie1 antibody treated tumors have a distinct morphology even though blood vessel density may not be altered. In anti-Tie antibody treated tumors, the vessels form septa-like structures in between lobuli of tumor cells. These tumors also have more necrosis than control antibody treated tumors. The distribution of smooth muscle cells (as detected by anti-smooth muscle actin antibody staining) was also altered. The lymphatic vessels in anti-Tie1 antibody treated tumors were also more dispersed, somewhat dilated and in several instances composed of adjacent lumina clustered together in a string. These observations indicate that this anti-Tie antibody has a distinctive effect on tumor necrosis and vessel organization within the tumor.

Example 43

Evaluating Combination Therapies

An animal model can be used to evaluate combination therapies. For example, the combinations (provided intraperitoneally) can be tested for ability to modulate tumor growth in female NCr nu/nu mice with xenografts of HT29, COLO205, or PC3. The following are some exemplary test regimes:

| Compound | Dose for HT29 and COLO205 xenografts | Schedule |
|---|---|---|
| PBS | 0.2 ml/20 g | Q2Dx14; D4 |
| DX-2230 | 10 mg/kg/inj | Q2Dx14; D4 |
| DX-2230 + avastin | 10 mg/kg/inj; 2.5 mg/kg/inj | Q2Dx14; D4, Q3Dx3; D3 |
| avastin | 2.5 mg/kg/inj | Q3Dx3; D4 |
| A2-SV (control) | 10 mg/kg/inj | Q2Dx14; D4 |

Another regime is as follows:

| Compound | Dose for PC3 xenografts | Schedule |
|---|---|---|
| PBS | 0.2 ml/20 g | Q2Dx14; D4 |
| DX-2230 | 10 mg/kg/inj | Q2Dx14; D4 |
| DX-2230 + cyclophosphamide | 10 mg/kg/inj; 150 mg/kg/inj | Q2Dx14; D4, QDx1; D4 |
| cyclophosphamide | 150 mg/kg/inj | QDx1; D4 |
| A2-SV (control) | 10 mg/kg/inj | Q2Dx14; D4 |

A2-SV is the control anti-streptavidin antibody. Twelve animals can be used in each group. Clinical signs, mean group weights are evaluated every day. Individual body weights and tumor burden are evaluated twice weekly. At study termination, tissue samples can be obtained from tumors, liver, lung, spleen, heart, axial node, kidney, and uterus.

Other embodiments are within the following claims:

SEQUENCE LISTING (726 sequences)

SEQ ID NO: 1 - DNA, 3417 bp, Homo sapiens
  CDS (1)...(3414)
atggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagcttgtgcccctggtcattttggggctgattgccgactccagtgccagtgtcagaatggtggcacttgtgaccggttcagtggttgtgtctgcccctctgggtggcatggagtgcactgtgagaagtcagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctgtccaccaaggccattgtggagccagagaagaccacagctgagttcgaggtgccccgcttggttcttgcggacagtgggttctgggagtgccgtgtgtccacatctggcggccaagacagccggcgcttcaaggtcaatgtgaaagtgccccccgtgcccctggctgcacctcggctcctgaccaagcagagccgccagcttgtggtctccccgctggtctcgttctctggggatggacccatctccactgtccgcctgcactaccggccccaggacagtaccatggactggtcgaccattgtggtggaccccagtgagaacgtgacgttaatgaacctgaggccaaagacaggatacagtgttcgtgtgcagctgagccggccaggggaaggaggagagggggcctgggggcctcccaccctcatgaccacagactgtcctgagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgcactgccctcctgacgggactcacgcctggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggccgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctga

SEQ ID NO: 2 - protein, 1138 aa, Homo sapiens
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWHGVHCEKSDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 3 - DNA, 396 bp, Artificial Sequence
  Synthetically generated oligonucleotide
  CDS (1)...(396)
gaagttcaattgttagagtctggtggcggtcttgttcagcctggtggttctttacgtctttcttgcgctgcttccggattcactttctctatttacaagatgtcttgggttcgccaagctcctggtaaaggtttggagtgggtttcttctatctatccttctggtggccagactaagtatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggc

SEQ ID NO: 4 - protein, 132 aa, Artificial Sequence
  Synthetically generated peptide
EVQLLESGGGLVQPGGSLRLSCAASGFTFSIYKMSWVRQAPGKGLEWVSSIYPSGGQTKYADSVKGRFTISRDNSKNTLYLQMNSLRAEDTAVYYCARVNYYDSSGYGPIAPGLDYWGQGTLVTVSSASTKG

SEQ ID NO: 5 - DNA, 311 bp, Artificial Sequence
  Synthetically generated oligonucleotide
  CDS (1)...(309)
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcccggtggacgttcggccaagggac

SEQ ID NO: 6 - protein, 103 aa, Artificial Sequence
  Synthetically generated peptide
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSRWTFGQG

SEQ ID NO: 7 - DNA, 396 bp, Artificial Sequence
  Synthetically generated oligonucleotide
  CDS (1)...(396)
gaagttcaattgttagagtctggtggcggtcttgttcagcctggtggttctttacgtctttcttgcgctgcttccggattcactttctcttattaccttatgtattgggttcgccaagctcctggtaaaggtttggagtgggtttcttctatctatccttctggtggctggactgtttatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggc

SEQ ID NO: 8 - protein, 132 aa, Artificial Sequence
  Synthetically generated peptide
EVQLLESGGGLVQPGGSLRLSCAASGFTFSYYLMYWVRQAPGKGLEWVSSIYPSGGWTVYADSVKGRFTISRDNSKNTLYLQMNSLRAEDTAVYYCARVNYYDSSGYGPIAPGLDYWGQGTLVTVSSASTKG

SEQ ID NO: 9 - DNA, 308 bp, Artificial Sequence
  Synthetically generated oligonucleotide
  CDS (1)...(306)
caagacatccagatgacccagtctccatcctccctgtctgcatctgtcggagacagagtcaccatcacttgccgggcaagttagagcattagcacctctttaaattggtatcagcaaaaatcagggaaagcccctaagctcctgatatatgctgcatccagtttgcaaagtgaagtcccatcaaggttcagtggcagtggatctgggacagatttcactctcaccatcaccagtctgcaacctgaagattttgcaacttactactgtcaacagagttacagtacccctccgactttcggccaagggac

SEQ ID NO: 10 - protein, 101 aa, Artificial Sequence
  Synthetically generated peptide
QDIQMTQSPSSLSASVGDRVTITCRASSISTSLNWYQQKSGKAPKLLIYAASSLQSEVPSRFSGSGSGTDFTLTITSLQPEDFATYYCQQSYSTPPTFGQG

SEQ ID NO: 11 - DNA, 439 bp, Artificial Sequence
  Synthetically generated oligonucleotide
  CDS (1)...(438)
gaagttcaattgttagagtctggtggcggtcttgttcagcctggtggttctttacgtctttcttgcgctgcttccggattcactttctctatgtacgttatgaagtgggttcgccaagctcctggtaaaggtttggagtgggtttcttctatctatccttctggtggctatactcgttatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggcccatcggtcttcccgctagcaccctcctccaagagcacctctg

SEQ ID NO: 12 - protein, 146 aa, Artificial Sequence
  Synthetically generated peptide
EVQLLESGGGLVQPGGSLRLSCAASGFTFSMYVMKWVRQAPGKGLEWVSSIYPSGGYTRYADSVKGRFTISRDNSKNTLYLQMNSLRAEDTAVYYCARVNYYDSSGYGPIAPGLDYWGQGTLVTVSSASTKGPSVFPLAPSSKSTS

SEQ ID NO: 13 - DNA, 311 bp, Artificial Sequence
  Synthetically generated oligonucleotide
  CDS (1)...(309)
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctccctattcactttcggccctgggac

SEQ ID NO: 14 - protein, 103 aa, Artificial Sequence
  Synthetically generated peptide
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSLFTFGPG

SEQ ID NO: 15 - DNA, 439 bp, Artificial Sequence
  Synthetically generated oligonucleotide
  CDS (1)...(438)
gaagttcaattgttagagtctggtggcggtcttgttcagcctggtggttctttacgtctttcttgcgctgcttccggattcactttctcttcttacaagatgggttgggttcgccaagctcctggtaaaggtttggagtgggtttcttggatctatccttctggtggcggtactacttatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggcccatcggtcttcccgctagcaccctcctccaagagcacctctg

SEQ ID NO: 16 - protein, 146 aa, Artificial Sequence
  Synthetically generated peptide
EVQLLESGGGLVQPGGSLRLSCAASGFTFSSYKMGWVRQAPGKGLEWVSWIYPSGGGTTYADSVKGRFTISRDNSKNTLYLQMNSLRAEDTAVYYCARVNYYDSSGYGPIAPGLDYWGQGTLVTVSSASTKGPSVFPLAPSSKSTS

SEQ ID NO: 17 - DNA, 311 bp, Artificial Sequence
  Synthetically generated oligonucleotide
  CDS (1)...(309)
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggac

SEQ ID NO: 18 - protein, 103 aa, Artificial Sequence
  Synthetically generated peptide
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQG

SEQ ID NO: 19 - DNA, 446 bp, Artificial Sequence
  Synthetically generated oligonucleotide
  CDS (1)...(444)
gaagttcaattgttagagtctggtggcggtcttgttcagcctggtggttctttacgtctttcttgcgctgcttccggattcactttctctcgttaccctatggtttgggttcgccaagctcctggtaaaggtttggagtgggtttctgttatctctccttctggtggccagactttttatgctgactccgttaaaggtcgcttcactatctctagagacaactctaagaatactctctacttgcagatgaacagcttaagggctgaggacactgcagtctactattgtgcgagaggggtcctcaccaccgcttttgatatctggggccaagggacaatggtcaccgtctcaagcgcctccaccaagggcccatcggtcttcccgctagcaccctcctccaaagcacctctgggggcacagcggccctgggctgcctggtcaaggac

SEQ ID NO: 20 - protein, 148 aa, Artificial Sequence
  Synthetically generated peptide
EVQLLESGGGLVQPGGSLRLSCAASGFTFSRYPMVWVRQAPGKGLEWVSVISPSGGQTFYADSVKGRFTISRDNSKNTLYLQMNSLRAEDTAVYYCARGVLTTAFDIWGQGTMVTVSSASTKGPSVFPLAPSSKAPLGAQRPWAAWSR

SEQ ID NO: 21 - DNA, 308 bp, Artificial Sequence
  Synthetically generated oligonucleotide
  CDS (1)...(306)
caagacatccagatgacccagtctccatcctccctgtctgcatctgtgggagacagagtcaccatcacttgccgggcaagtcagaacattaacagctatttaaattggtatcagcagaaaccagggcaagcccctaaactcctgatctatgctgcctccaatttggaaactgcggtcccatcaaggttcagcggcagtggatctgggacagatttcactctcaccatcagtagcctgcagcctgaagattttgcaacttattattgtcaacaatttaatacttaccctctcactttcggcggagggac

SEQ ID NO: 22 - protein, 102 aa, Artificial Sequence
  Synthetically generated peptide
QDIQMTQSPSSLSASVGDRVTITCRASQNINSYLNWYQQKPGQAPKLLIYAASNLETAVPSRFSGSGSGTDFTLTISSLQPEDFATYYCQQFNTYPLTFGGG

SEQ ID NO: 23 - DNA, 393 bp, Artificial Sequence
  Synthetically generated oligonucleotide
  CDS (1)...(393)
gaagttcaattgttagagtctggtggcggtcttgttcagcctggtggttctttacgtctttcttgcgctgcttccggattcactttctctcgttacggtatgcattgggttcgccaagctcctggtaaaggtttggagtgggtttctgttatctctccttctggtggcatgacttattatgctgactccgttaaaggtcgcttcactatctctagagacaacactaagaatactctctacttgcagatgaacagcttaagggctgaggacactgcagtctactattgtgcgagagtgggagctaccgggccttttgatatctggggccaagggacaatggtcaccgtctcaagcgcctccaccaagggcccatcggtcttcccgctagcaccc

SEQ ID NO: 24 - protein, 131 aa, Artificial Sequence
  Synthetically generated peptide
EVQLLESGGGLVQPGGSLRLSCAASGFTFSRYGMHWVRQAPGKGLEWVSVISPSGGMTYYADSVKGRFTISRDNTKNTLYLQMNSLRAEDTAVYYCARVGATGPFDIWGQGTMVTVSSASTKGPSVFPLAP

SEQ ID NO: 25 - DNA, 308 bp, Artificial Sequence
  Synthetically generated oligonucleotide
  CDS (1)...(306)
caagacatccagatgacccagtctccagccaccctgtctttgtctccaggggaaagagccaccctctcctgcagggccagtcagagtgttagcacctacttagcctggtaccaacagaaacctggccaggctcccaggcttctcatctatgatgcatccaacagggccactggcatcccaggcaggttcagtggcagtgggtctgggacagacttcactctcaccatcagcagcctagaggctgaagactttgcagtttattactgtcagcagcgtagcagctggccgatcaccttcggccaagggac

SEQ ID NO: 26 - protein, 102 aa, Artificial Sequence
  Synthetically generated peptide
QDIQMTQSPATLSLSPGERATLSCRASQSVSTYLAWYQQKPGQAPRLLIYDASNRATGIPGRFSGSGSGTDFTLTISSLEAEDFAVYYCQQRSSWPITFGQG

SEQ ID NO: 27 - DNA, 429 bp, Artificial Sequence
  Synthetically generated oligonucleotide
  CDS (1)...(429)
gaagttcaattgttagagtctggtggcggtcttgttcagcctggtggttctttacgtctttcttgcgctgcttccggattcactttctctcattacggtatgacttgggttcgccaagctcctggtaaaggtttggagtgggtttctgttatctctccttctggtggccagactggttatgctgactccgttaaaggtcgcttcactatctctagagacaactctaagaatactctctacttgcagatgaacagcttaagggctgaggacactgcagtctactattgtgcgggtggtggctacgcagcctttgactactggggccagggaaccctggtcaccgtctcaagcgcctccaccaagggcccatcggtcttcccgctagcaccctcctccaagagcacctctgggggcacagcggccctgggc

SEQ ID NO: 28 - protein, 143 aa, Artificial Sequence
  Synthetically generated peptide
EVQLLESGGGLVQPGGSLRLSCAASGFTFSHYGMTWVRQAPGKGLEWVSVISPSGGQTGYADSVKGRFTISRDNSKNTLYLQMNSLRAEDTAVYYCAGGGYAAFDYWGQGTLVTVSSASTKGPSVFPLAPSSKSTSGGTAALG

SEQ ID NO: 29 - DNA, 308 bp, Artificial Sequence
  Synthetically generated oligonucleotide
  CDS (1)...(306)
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggac

SEQ ID NO: 30 - protein, 102 aa, Artificial Sequence
  Synthetically generated peptide
QDIQMTQSPATLSLSPGERATLSCRASQSVSSYLAWYQQKPGQAPRLLIYDASNRATGIPARFSGSGSGTDFTLTISSLEPEDFAVYYCQQRSNWPLTFGGG

SEQ ID NO: 31 - DNA, 396 bp, Artificial Sequence
  Synthetically generated oligonucleotide
  CDS (1)...(396)
gaagttcaattgttagagtctggtggcggtcttgttcagcctggtggttctttacgtctttcttgcgctgcttccggattcactttctctgcttaccgtatggagtgggttcgccaagctcctggtaaaggtttggagtgggtttcttctatctatccttctggtggcattacttattatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggc

SEQ ID NO: 32 - protein, 132 aa, Artificial Sequence
  Synthetically generated peptide
EVQLLESGGGLVQPGGSLRLSCAASGFTFSAYRMEWVRQAPGKGLEWVSSIYPSGGITYYADSVKGRFTISRDNSKNTLYLQMNSLRAEDTAVYYCARVNYYDSSGYGPIAPGLDYWGQGTLVTVSSASTKG

SEQ ID NO: 33 - DNA, 308 bp, Artificial Sequence
  Synthetically generated oligonucleotide
  CDS (1)...(306)
caagacatccagatgacccagtctccatcctccctgtctgcatctgtaggagacagagttaccatcacttgccgggcaagtcagggcattaccacttatttaggctggtattagcagaaaccagggaaagcccctaagctcctgatctatgctgcatccactttgcaaagtggggtcccagcaaagttcagcggcagtggatctgggacacttttcactctcaccatcagcggtctgcaacctgaagattctgcaacttactactgtcaccagagttacaataccccttggacgttcggccaagggac

SEQ ID NO: 34 - protein, 101 aa, Artificial Sequence
  Synthetically generated peptide
QDIQMTQSPSSLSASVGDRVTITCRASQGITTYLGWYQKPGKAPKLLIYAASTLQSGVPAKFSGSGSGTLFTLTISGLQPEDSATYYCHQSYNTPWTFGQG

SEQ ID NO: 35 - DNA, 412 bp, Artificial Sequence
  Synthetically generated oligonucleotide
  CDS (1)...(411)
gaagttcaattgttagagtctggtggcggtcttgttcagcctggtggttctttacgtctttcttgcgctgcttccggattcactttctctggttacggtatgcattgggttcgccaagctcctggtaaaggtttggagtgggtttctgttatctctccttctggtggccagacttggtaggctgactccgttaaaggtcgcttcactatctctagagacaactctaagaatactctctacttgcagatgaacagcttaagggctgaggacactgcagtctactattgtgcgagaggcgggaccagtaacccactgttttactggggccagggaaccctggtcaccgtctcaagcgcctccaccaagggcccatcggtcttcccgctagcaccctcctccaagagcacctctg

SEQ ID NO: 36 - protein, 136 aa, Artificial Sequence
  Synthetically generated peptide
EVQLLESGGGLVQPGGSLRLSCAASGFTFSGYGMHWVRQAPGKGLEWVSVISPSGGQTWADSVKGRFTISRDNSKNTLYLQMNSLRAEDTAVYYCARGGTSNPLFYWGQGTLVTVSSASTKGPSVFPLAPSSKSTS

SEQ ID NO: 37 - DNA, 308 bp, Artificial Sequence
  Synthetically generated oligonucleotide
  CDS (1)...(306)
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgacttttggccaggggac

SEQ ID NO: 38 - protein, 102 aa, Artificial Sequence
  Synthetically generated peptide
QDIQMTQSPATLSLSPGERATLSCRASQSVSSYLAWYQQKPGQAPRLLIYDASNRATGIPARFSGSGSGTDFTLTISSLEPEDFAVYYCQQRSNWPPTFGQG

SEQ ID NO: 39 - DNA, 444 bp, Artificial Sequence
  Synthetically generated oligonucleotide
  CDS (1)...(444)
gaagttcaattgttagagtctggtggcggtcttgttcagcctggtggttctttacgtctttcttgcgctgcttccggattcactttctctggttacggtatgcattgggttcgccaagctcctggtaaaggtttggagtgggtttctgttatctctccttctggtggccagacttcttatgctgactccgttaaaggtcgcttcactatctctagagacaactctaagaatactctctacttgcagatgaacagcttaagggctgaggacactgcagtctactattgtgcgagagataggcagtattactatggttcggggagtcttgactactggggccagggaaccctggtcaccgtctcaagcgcctccaccaagggcccatcggtcttcccgctagcaccctcctccaagagcacctctgggggcacagcggccctgggc

SEQ ID NO: 40 - protein, 148 aa, Artificial Sequence
  Synthetically generated peptide
EVQLLESGGGLVQPGGSLRLSCAASGFTFSGYGMHWVRQAPGKGLEWVSVISPSGGQTSYADSVKGRFTISRDNSKNTLYLQMNSLRAEDTAVYYCARDRQYYYGSGSLDYWGQGTLVTVSSASTKGPSVFPLAPSSKSTSGGTAALG

SEQ ID NO: 41 - DNA, 308 bp, Artificial Sequence
  Synthetically generated oligonucleotide
  CDS (1)...(306)
caagacatccagatgacccagtctccatcctccctgtctgcatctgtaggagacagagtcaccgtcacttgccgggcaagtcagagcattagcagttatttaaattggtatcagcagaaaccagggaaagcccctaaactcctgatctatgctgcatccagtttgcaaagtggggtcccatcaaggttcagtggcggtggatctgggacagatttcactctcaccatcagcagtctgcaacctgaagattttgcaacttatttctgtctacaagattacaaatacccgtggacgttcggccaagggac

SEQ ID NO: 42 - protein, 102 aa, Artificial Sequence
  Synthetically generated peptide
QDIQMTQSPSSLSASVGDRVTVTCRASQSISSYLNWYQQKPGKAPKLLIYAASSLQSGVPSRFSGGGSGTDFTLTISSLQPEDFATYFCLQDYKYPWTFGQG

SEQ ID NO: 43 - DNA, 375 bp, Artificial Sequence
  Synthetically generated oligonucleotide
  CDS (1)...(375)
gaagttcaattgttagagtctggtggcggtcttgttcagcctggtggttctttacgtctttcttgcgctgcttccggattcactttctctatgtacggtatgggttgggttcgccaagctcctggtaaaggtttggagtgggtttctgttatctctccttctggtggccagactgcttatgctgactccgttaaaggtcgcttcactatctctagagacaactctaagaatactctctacttgcagatgaacagcttaagggctgaggacactgcagtctactattgtgcgagagtggccttgctcctgggccacgcttttgatatctggggccaagggacaatggtcaccgtctcaagcgcctccaccaagggc

SEQ ID NO: 44 - protein, 125 aa, Artificial Sequence
  Synthetically generated peptide
EVQLLESGGGLVQPGGSLRLSCAASGFTFSMYGMGWVRQAPGKGLEWVSVISPSGGQTAYADSVKGRFTISRDNSKNTLYLQMNSLRAEDTAVYYCARVALLLGHAFDIWGQGTMVTVSSASTKG

SEQ ID NO: 45 - DNA, 308 bp, Artificial Sequence
  Synthetically generated oligonucleotide
  CDS (1)...(306)
caagacatccagatgacccagtctccttccaccctgtctgcatctttaggagacagagtcaccatcacttgccgggccagtgagagtattagtaggtggttggcctggtatcagcagaaaccagggaaagcccctaagctcctgatgtatgaggcatccactttagaaagtggggtcccatcaaggttcaccggcactggatctgggacagaattcactctcaccatcagcagcctgcagcccgatgattttgcaacttattactgtcagcagcgtagcaactggcccctcactttcggcggagggac

SEQ ID NO: 46 - protein, 102 aa, Artificial Sequence
  Synthetically generated peptide
QDIQMTQSPSTLSASLGDRVTITCRASESISRWLAWYQQKPGKAPKLLMYEASTLESGVPSRFTGTGSGTEFTLTISSLQPDDFATYYCQQRSNWPLTFGGG

SEQ ID NO: 47 - DNA, 429 bp, Artificial Sequence
  Synthetically generated oligonucleotide
  CDS (1)...(429)
gaagttcaattgttagagtctggtggcggtcttgttcagcctggtggttctttacgtctttcttgcgctgcttccggattcactttctctgcttacatgatgtcttgggttcgccaagctcctggtaaaggtttggagtgggtttcttctatctatccttctggtggctatacttattatgctgactccgttaaaggtcgcttcactatctctagagacaactctaagaatactctctacttgcagatgaacagcttaagggctgaggacactgcagtctactattgtgcgagaggcttacggggaggtcctgactactggggccagggaaccctggtcaccgtctcaagcgcctccaccaagggcccatcggtcttcccgctagcaccctcctccaagagcacctctgggggcacagcggccctgggc

SEQ ID NO: 48 - protein, 143 aa, Artificial Sequence
  Synthetically generated peptide
EVQLLESGGGLVQPGGSLRLSCAASGFTFSAYMMSWVRQAPGKGLEWVSSIYPSGGYTYYADSVKGRFTISRDNSKNTLYLQMNSLRAEDTAVYYCARGLRGGPDYWGQGTLVTVSSASTKGPSVFPLAPSSKSTSGGTAALG

SEQ ID NO: 49 - DNA, 308 bp, Artificial Sequence
  Synthetically generated oligonucleotide
  CDS (1)...(306)
caagacatccagatgacccagtctccttccaccctgtctgcatatgtaggagacagtgtcaccatcacttgccgggccagtcagagtgtgagaaggtcgttggcctggtatcagcagagaccagggaaagcccccaagtccctcatctataaggcgtctactttagagactggggtcccaccaaggttcagcggcagtggatctgggacagaattcactctcaccatcagcagcctgcagcctgaagattctgcaatttattactgccaacaatatggtagttttccgctcactttcggcggagggac

SEQ ID NO: 50 - protein, 102 aa, Artificial Sequence
  Synthetically generated peptide
QDIQMTQSPSTLSAYVGDSVTITCRASQSVRRSLAWYQQRPGKAPKSLIYKASTLETGVPPRFSGSGSGTEFTLTISSLQPEDSAIYYCQQYGSFPLTFGGG

SEQ ID NO: 51 - DNA, 441 bp, Artificial Sequence
  Synthetically generated oligonucleotide
  CDS (1)...(441)
gaagttcaattgttagagtctggtggcggtcttgttcagcctggtggttctttacgtctttcttgcgctgcttccggattcactttctctcattacatgatggtttgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacactgcagtctactattgtgcgaggctggactacggtggtaattccgcctactttgactactggggccagggaaccctggtcaccgtctcaagcgcctccaccaagggcccatcggtcttcccgctagcaccctcctccaagagcacctctgggggcacagcggccctgggc

SEQ ID NO: 52 - protein, 147 aa, Artificial Sequence
  Synthetically generated peptide
EVQLLESGGGLVQPGGSLRLSCAASGFTFSHYMMVWVRQAPGKGLEWVSSIYPSGGWTYYADSVKGRFTISRDNSKNTLYLQMNSLRAEDTAVYYCARLDYGGNSAYFDYWGQGTLVTVSSASTKGPSVFPLAPSSKSTSGGTAALG

SEQ ID NO: 53 - DNA, 327 bp, Artificial Sequence
  Synthetically generated oligonucleotide
  CDS (1)...(327)
cagagcgtcttgactcagccgcactctgtgtcggcctctccggggaagacggtaaccatctcctgcacccgcagcagtggcaacattgccagcaactttgtccagtggtaccaacagcgcccgggcagtgtccccaccactgtgatttatgaagatgaccgaagaccctctggggtccctgatcgcttttctggctccatcgacagttcctccaactctgctttcctcagcatctctggactgaagactgaggacgaggcagactattactgtcagtctcatgatcgtaccacccgtgcttgggtgttcggcggagggaccaagctg

SEQ ID NO: 54 - protein, 109 aa, Artificial Sequence
  Synthetically generated peptide
QSVLTQPHSVSASPGKTVTISCTRSSGNIASNFVQWYQQRPGSVPTTVIYEDDRRPSGVPDRFSGSIDSSSNSAFLSISGLKTEDEADYYCQSHDRTTRAWVFGGGTKL

SEQ ID NO: 55 - DNA, 413 bp, Artificial Sequence
  Synthetically generated oligonucleotide
  CDS (1)...(411)
gaagttcaattgttagagtctggtggcggtcttgttcagcctggtggttctttacgtctttcttgcgctgcttccggattcactttctctcgttacactatgatgtgggttcgccaagctcctggtaaaggtttggagtgggtttctggtatctatccttctggtggcgttactctttatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggcccatcggtcttcccgct

SEQ ID NO: 56 - protein, 137 aa, Artificial Sequence
  Synthetically generated peptide
EVQLLESGGGLVQPGGSLRLSCAASGFTFSRYTMMWVRQAPGKGLEWVSGIYPSGGVTLYADSVKGRFTISRDNSKNTLYLQMNSLRAEDTAVYYCARVNYYDSSGYGPIAPGLDYWGQGTLVTVSSASTKGPSVFP

SEQ ID NO: 57 - DNA, 339 bp, Artificial Sequence
  Synthetically generated oligonucleotide
  CDS (1)...(339)
cacagtgcacaagacatccagatgacccagtctccaggcaccctgtctttgtctccaggggaaagagccacactctcctgcagggccagtcggagtgtgatcatcagctacgtagcctggtaccagcagaaacctggccaggctcccaggctcctcatctatggagcgtccaccagggccactggcatcccagacaggttcagtggcagtgggtctgggacagacttcactctcaccatcagcagactggagcctgaagactttgcagtgtatttctgtcagctttatggtaggtcaccacggatcatcttcggccaagggacacgactggagattaaa

SEQ ID NO: 58 - protein, 113 aa, Artificial Sequence
  Synthetically generated peptide
HSAQDIQMTQSPGTLSLSPGERATLSCRASRSVIISYVAWYQQKPGQAPRLLIYGASTRATGIPDRFSGSGSGTDFTLTISRLEPEDFAVYFCQLYGRSPRIIFGQGTRLEIK

SEQ ID NO: 59 - DNA, 369 bp, Artificial Sequence
  Synthetically generated oligonucleotide
  CDS (1)...(369)
gaagttcaattgttagagtctggtggcggtcttgttcagcctggtggttctttacgtctttcttgcgctgcttccggattcactttctctaattacgttatggtttgggttcgccaagctcctggtaaaggtttggagtgggtttctggtatctatccttctggtggccatactaagtatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtc

SEQ ID NO: 60 - protein, 123 aa, Artificial Sequence
  Synthetically generated peptide
EVQLLESGGGLVQPGGSLRLSCAASGFTFSNYVMVWVRQAPGKGLEWVSGIYPSGGHTKYADSVKGRFTISRDNSKNTLYLQMNSLRAEDTAVYYCARVNYYDSSGYGPIAPGLDYWGQGTLV

SEQ ID NO: 61 - DNA, 339 bp, Artificial Sequence
  Synthetically generated oligonucleotide
  CDS (1)...(339)
cacagtgcacaagacatccagatgacccagtctccaggcaccctgtctttgtctccaggggaaagagccaccctcttctgcagggccagtcagcgtgttaccagcaactccttggcctggtaccagcagagacctggccaggctcccaggctcctcatctatgatgcatccaccagggccactggcatcccagaccgcttcagtggcagtgggtcggggagggacttcactctcaccatcagcagactggagcctgaagattttgcagtttattactgtcagcgatatggtagttcagtgttgtactcttttggccaggggacgaagttggaaatcaca

SEQ ID NO: 62 - protein, 113 aa, Artificial Sequence
  Synthetically generated peptide
HSAQDIQMTQSPGTLSLSPGERATLFCRASQRVTSNSLAWYQQRPGQAPRLLIYDASTRATGIPDRFSGSGSGRDFTLTISRLEPEDFAVYYCQRYGSSVLYSFGQGTKLEIT

SEQ ID NO: 63 - DNA, 383 bp, Artificial Sequence
  Synthetically generated oligonucleotide
  CDS (1)...(381)
gaagttcaattgttagagtctggtggcggtcttgttcagcctggtggttctttacgtctttcttgcgctgcttccggattcactttctctatttacggtatggcttgggttcgccaagctcctggtaaaggtttggagtgggtttctgttatctctccttctggtggccagactttttatgctgactccgttaaaggtcgcttcactatctctagagacaactctaagaatactctctacttgcagatgaacagcttaagggctgaggacactgcagtctactattgtgcgagagtttactactacggtatggacgtctggggccaagggaccacggtcaccgtctcaagcgcctccaccaagggcccatcggtcttcccgct

SEQ ID NO: 64 - protein, 127 aa, Artificial Sequence
  Synthetically generated peptide
EVQLLESGGGLVQPGGSLRLSCAASGFTFSIYGMAWVRQAPGKGLEWVSVISPSGGQTFYADSVKGRFTISRDNSKNTLYLQMNSLRAEDTAVYYCARVYYYGMDVWGQGTTVTVSSASTKGPSVFP

SEQ ID NO: 65 - DNA, 333 bp, Artificial Sequence
  Synthetically generated oligonucleotide
  CDS (1)...(333)
cacagtgcacaagacatccagatgacccagtctccagccaccctgtctttgtctccaggggaaagagccaccctctcctgcagggccagtcagagtgttagcagctacttagcctggtaccaacaaaaacctggccaggctcccaggctcctcatttatgatgcatccaacagggccactggcatcccagccaggttcagtggcagtgggtctgagacagacttcactctcaccatcagcagcctagagcctgaagattttgcagtttattactgtcagcagcgtagcaagtggcctcggacttttggccaggggaccaagctggagatcaaa

SEQ ID NO: 66 - protein, 111 aa, Artificial Sequence
  Synthetically generated peptide
HSAQDIQMTQSPATLSLSPGERATLSCRASQSVSSYLAWYQQKPGQAPRLLIYDASNRATGIPARFSGSGSETDFTLTISSLEPEDFAVYYCQQRSKWPRTFGQGTKLEIK

SEQ ID NO: 67 - DNA, 413 bp, Artificial Sequence
  Synthetically generated oligonucleotide
  CDS (1)...(411)
gaagttcaattgttagagtctggtggcggtcttgttcagcctggtggttctttacgtctttcttgcgctgcttccggattcactttctcttcttacgttatgatgtgggttcgccaagctcctggtaaaggtttggagtgggtttctggtatctatccttctggtggctggacttattatactgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggcccatcggtcttcccgct

SEQ ID NO: 68 - protein, 137 aa, Artificial Sequence
  Synthetically generated peptide
EVQLLESGGGLVQPGGSLRLSCAASGFTFSSYVMMWVRQAPGKGLEWVSGIYPSGGWTYYTDSVKGRFTISRDNSKNTLYLQMNSLRAEDTAVYYCARVNYYDSSGYGPIAPGLDYWGQGTLVTVSSASTKGPSVFP

SEQ ID NO: 69 - DNA, 336 bp, Artificial Sequence
  Synthetically generated oligonucleotide
  CDS (1)...(336)
cacagtgcacaagacatccagatgacccagtctccatcctccctgtctgcatctgttggagatagagtcaccatcacttgccgggcaagtcagagtgtcagcagtcatttaagttggtttcagcagagaccagggaaagcccccaacctcctgatctatcatgcatccagtttgcaaagtggggtcccatcaaggttcagtggcagtgggtctgggacagatttcacgctcaccatcagcagtctgcaacctgaagattttgcaacttactactgtcagcagagttacgctacttcctcgatcaccttcggccaggggacacgactggacattaaa

SEQ ID NO: 70 - protein, 112 aa, Artificial Sequence
  Synthetically generated peptide
HSAQDIQMTQSPSSLSASVGDRVTITCRASQSVSSHLSWFQQRPGKAPNLLIYHASSLQSGVPSRFSGSGSGTDFTLTISSLQPEDFATYYCQQSYATSSITFGQGTRLDIK

SEQ ID NO: 71 - DNA, 413 bp, Artificial Sequence
  Synthetically generated oligonucleotide
  CDS (1)...(411)
gaagttcaattgttagagtctggtggcggtcttgttcagcctggtggttctttacgtctttcttgcgctgcttccggattcactttctctcgttacaagatgaagtgggttcgccaagctcctggtaaaggtttggagtgggtttctgttatctatccttctggtggcggtactggttatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggcccatcggtcttcccgct

SEQ ID NO: 72 - protein, 137 aa, Artificial Sequence
  Synthetically generated peptide
EVQLLESGGGLVQPGGSLRLSCAASGFTFSRYKMKWVRQAPGKGLEWVSVIYPSGGGTGYADSVKGRFTISRDNSKNTLYLQMNSLRAEDTAVYYCARVNYYDSSGYGPIAPGLDYWGQGTLVTVSSASTKGPSVFP

SEQ ID NO: 73 - DNA, 428 bp, Artificial Sequence
  Synthetically generated oligonucleotide
  CDS (1)...(426)
cacagtgcacagagcgtcttgactcagcctgactccgtgtctgggtctcctggagagtcgatcaccatctcctgcactggaagcagcagagacgttggtggttataactatgtctcctggtaccaacaacacccaggcaaagcccccaaactcttgctttatgatgtcacttatcggccctcagggatttctggtcgcttctctggctccaagtctggcgacacggcctccctgaccatctctgggctccggactgaggacgaggctgattattactgcagctcatctataggcaccaggacttatgtcttcggaagtgggaccaaggtcaccgtcctacgtcagcccaaggccaaccccactgtcactctgttcccgccctcctctgaggagctccaagccaacaaggccacactagtgtgtctgat

SEQ ID NO: 74 - protein, 142 aa, Artificial Sequence
  Synthetically generated peptide
HSAQSVLTQPDSVSGSPGESITISCTGSSRDVGGYNYVSWYQQHPGKAPKLLLYDVTYRPSGISGRFSGSKSGDTASLTISGLRTEDEADYYCSSSIGTRTYVFGSGTKVTVLRQPKANPTVTLFPPSSEELQANKATLVCL

SEQ ID NO: 75 - DNA, 386 bp, Artificial Sequence
  Synthetically generated oligonucleotide
  CDS (1)...(384)
gaagttcaattgttagagtctggtggcggtcttgttcagcctggtggttctttacgtctttcttgcgctgcttccggattcactttctctcgttacgttatgtattgggttcgccaagctcctggtaaaggtttggagtgggtttctgttatctatccttctggtggcgctacttattatgctgactccgttaaaggtcgcttcactatctctagagacaactctaagaatactctctacttgcagatgaacagcttaagggctgaggacactgcagtctactattgtgcgagacggggaagtagtggtgcgtttgactactggggccagggaaccctggtcaccgtctcaagcgcctccaccaagggcccatcggtcttcccgct

SEQ ID NO: 76 - protein, 128 aa, Artificial Sequence
  Synthetically generated peptide
EVQLLESGGGLVQPGGSLRLSCAASGFTFSRYVMYWVRQAPGKGLEWVSVIYPSGGATYYADSVKGRFTISRDNSKNTLYLQMNSLRAEDTAVYYCARRGSSGAFDYWGQGTLVTVSSASTKGPSVFP

SEQ ID NO: 77 - DNA, 434 bp, Artificial Sequence
  Synthetically generated oligonucleotide
  CDS (1)...(432)
cacagtgcacagagcgtcttgactcagcctgcctccgtgtctgggtctcctggacagtcgatcaccatctcctgcactggaaccagcagtgacattggtcgttataactatgcctcctggtaccaacaacgcccaggcaaatcccccaaactcctgatttatgaggtcagtgatcggccctcaggggtttctaatcgcttctctggctccaagtctggcaacacggcctccctgatcatctctgggctccaggctgaggacgaggctgattattactgcagctcatattcaagcaccaacagtctccaagtggtattcggcggagggaccaagctgagcgtcctaggtcagcccaaggctgccccctcggtcactctgttcccgccctcctctgaggagcttcaagccaacaaggccacactggtgtgtctcat

SEQ ID NO: 78 - protein, 144 aa, Artificial Sequence
  Synthetically generated peptide
HSAQSVLTQPASVSGSPGQSITISCTGTSSDIGRYNYASWYQQRPGKSPKLLIYEVSDRPSGVSNRFSGSKSGNTASLIISGLQAEDEADYYCSSYSSTNSLQVVFGGGTKLSVLGQPKAAPSVTLFPPSSEELQANKATLVCL

SEQ ID NO: 79 - DNA, 413 bp, Artificial Sequence
  Synthetically generated oligonucleotide
  CDS (1)...(411)
gaagttcaattgttagagtctggtggcggtcttgttcagcctggtggttctttacgtctttcttgcgctgcttccggattcactttctctgcttacggtatgtcttgggttcgccaagctcctggtaaaggtttggagtgggtttctgttatctatccttctggtggctggacttattatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggcccatcggtcttcccgct

SEQ ID NO: 80 - protein, 137 aa, Artificial Sequence
  Synthetically generated peptide
EVQLLESGGGLVQPGGSLRLSCAASGFTFSAYGMSWVRQAPGKGLEWVSVIYPSGGWTYYADSVKGRFTISRDNSKNTLYLQMNSLRAEDTAVYYCARVNYYDSSGYGPIAPGLDYWGQGTLVTVSSASTKGPSVFP

SEQ ID NO: 81 - DNA, 336 bp, Artificial Sequence
  Synthetically generated oligonucleotide
  CDS (1)...(336)
cacagtgcacaagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtataataactggcctcggacgttcggccaagggaccaaggtggaaatcaaa

SEQ ID NO: 82 - protein, 112 aa, Artificial Sequence
  Synthetically generated peptide
HSAQDIQMTQSPGTLSLSPGERATLSCRASQSVSSSYLAWYQQKPGQAPRLLIYGASSRATGIPDRFSGSGSGTDFTLTISRLEPEDFAVYYCQQYNNWPRTFGQGTKVEIK

SEQ ID NO: 83 - DNA, 395 bp, Artificial Sequence
  Synthetically generated oligonucleotide
  CDS (1)...(393)
gaagttcaattgttagagtctggtggcggtcttgttcagcctggtggttctttacgtctttcttgcgctgcttccggattcactttctctggttacgctatgtggtgggttcgccaagctcctggtaaaggtttggagtgggtttcttctatctctccttctggtggcgctactgcttatgctgactccgttaaaggtcgcttcactatctctagagacaactctaagaatactctctacttgcagatgaacagcttaagggctgaggacactgcagtctactattgtgcgagagatgcggggagttattattggggctggttcgacccctggggccagggaaccctggtcaccgtctcaagcgcctccaccaagggcccatcggtcttcccgct

SEQ ID NO: 84 - protein, 131 aa, Artificial Sequence
  Synthetically generated peptide
EVQLLESGGGLVQPGGSLRLSCAASGFTFSGYAMWWVRQAPGKGLEWVSSISPSGGATAYADSVKGRFTISRDNSKNTLYLQMNSLRAEDTAVYYCARDAGSYYWGWFDPWGQGTLVTVSSASTKGPSVFP

SEQ ID NO: 85 - DNA, 333 bp, Artificial Sequence
  Synthetically generated oligonucleotide
  CDS (1)...(333)
cacagtgcacaagacatccagatgacccagtctccagccaccttgtctttgtctccaggggaaagagccaccctctcctgcagggccagtcagagtattagcagctacttagcctggtaccaacagaaacctggccagcctcccaggctcctcatctatgatgcatccagcagggttactggcatcccagccaggttcagtggcagtggctttgggacagacttcactctcaccattagtagcctggagcctgaagattttgcagtttattactgtctccagcgtagcagctggccccgaacttttggccaggggaccaagctggagatcaaa

SEQ ID NO: 86 - protein, 111 aa, Artificial Sequence
  Synthetically generated peptide
HSAQDIQMTQSPATLSLSPGERATLSCRASQSISSYLAWYQQKPGQPPRLLIYDASSRVTGIPARFSGSGFGTDFTLTISSLEPEDFAVYYCLQRSSWPRTFGQGTKLEIK

SEQ ID NO: 87 - DNA, 413 bp, Artificial Sequence
  Synthetically generated oligonucleotide
  CDS (1)...(411)
gaagttcaattgttagagtctggtggcggtcttgttcagcctggtggttctttacgtctttcttgcgctgcttccggattcactttctctggttacgttatgttttgggttcgccaagctcctggtaaaggtttggagtgggtttctggtatctatccttctggtggctggactgtttatgctgactccgttaaaggtcgcttcactatctctagagacaactctaagaatactctctacttgcagatgaacagcttaagggctgaggacactgcagtctactattgtgcgagagtcaattactatgatagtagtggttacggtcctatagctcctggacttgactactggggccagggaaccctggtcaccgtctcaagcgcctccaccaagggcccatcggtcttcccgct

SEQ ID NO: 88 - protein, 137 aa, Artificial Sequence
  Synthetically generated peptide
EVQLLESGGGLVQPGGSLRLSCAASGFTFSGYVMFWVRQAPGKGLEWVSGIYPSGGWTVYADSVKGRFTISRDNSKNTLYLQMNSLRAEDTAVYYCARVNYYDSSGYGPIAPGLDYWGQGTLVTVSSASTKGPSVFP

SEQ ID NO: 89 - DNA, 333 bp, Artificial Sequence
  Synthetically generated oligonucleotide
  CDS (1)...(333)
cacagtgcacaagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcaatatggtagctcacggacgttcggccaagggaccaacgtggaaatcaaa

SEQ ID NO: 90 - protein, 111 aa, Artificial Sequence
  Synthetically generated peptide
HSAQDIQMTQSPGTLSLSPGERATLSCRASQSVSSSYLAWYQQKPGQAPRLLIYGASSRATGIPDRFSGSGSGTDFTLTISRLEPEDFAVYYCQQYGSSRTFGQGTNVEIK

SEQ ID NO: 91 - DNA, 395 bp, Artificial Sequence
  Synthetically generated oligonucleotide
  CDS (1)...(393)
gaagttcaattgttagagtctggtggcggtcttgttcagcctggtggttctttacgtctttcttgcgctgcttccggattcactttctcttcttacatgatgacttgggttcgccaagctcctggtaaaggtttggagtgggtttcttctatctatccttctggtggctatacttattatgctgactccgttaaaggtcgcttcactatctctagagacaactctaagaatactctctacttgcagatgaacagcttaagggctgaggacactgcagtctactattgtgcgagaggagggtatggcgactcgtcatttttttttgactactggggccagggaaccctggtcaccgtctcaagcgcctccaccaagggcccatcggtcttcccgct

SEQ ID NO: 92 - protein, 131 aa, Artificial Sequence
  Synthetically generated peptide
EVQLLESGGGLVQPGGSLRLSCAASGFTFSSYMMTWVRQAPGKGLEWVSSIYPSGGYTYYADSVKGRFTISRDNSKNTLYLQMNSLRAEDTAVYYCARGGYGDSSFFFDYWGQGTLVTVSSASTKGPSVFP

SEQ ID NO: 93 - DNA, 333 bp, Artificial Sequence
  Synthetically generated oligonucleotide
  CDS (1)...(333)
cacagtgcacaagacatccagatgacccagtctccagccaccctgtctgtgtctccaggggaaggagccaccctctcttgcagggccagtcggagtgttggcagcaacttagcctggtaccagcagaagcctggccaggctcccaggctcctcatctatgatgcatccaccagggccactggtatccccgccaggttcagtggcagtgggtctgggacaaagttcactctcaccatcagcagcctccagtctgaagattttgcagtttattactgtcagcagcgtagcaattggcctctcactttcggcggagggaccaaggtggagatcaaa

SEQ ID NO: 94 - protein, 111 aa, Artificial Sequence
  Synthetically generated peptide
HSAQDIQMTQSPATLSVSPGEGATLSCRASRSVGSNLAWYQQKPGQAPRLLIYDASTRATGIPARFSGSGSGTKFTLTISSLQSEDFAVYYCQQRSNWPLTFGGGTKVEIK

SEQ ID NO: 95 - DNA, 428 bp, Artificial Sequence
  Synthetically generated oligonucleotide
  CDS (1)...(426)
cacagtgcacagagcgtcttgactcagcctgcctccgtgtctgggtctcctggacagtcgatcaccatctcctgcactggaaccagcagtgacgttggtgatgataactatgtctcctggtaccaacaacacccagacaaagcccccaaactcatgatttatgaggtcagttatcggccctcaggggtttctaatcgcttctctggctccaagtctggcaacacggcctccctgaccatctctgggctccagactgaggacgaggctgattattattgcggctcatatcgcgtcagcagctcctatgtcttcggaactgggaccaaggtcaccgtcctaggtcagcccaaggccaaccccactgtcactctgttcccgccctcctctgaggagctccaagccaacaaggccacactagtgtgtctgat

SEQ ID NO: 96 - protein, 142 aa, Artificial Sequence
  Synthetically generated peptide
HSAQSVLTQPASVSGSPGQSITISCTGTSSDVGDDNYVSWYQQHPDKAPKLMIYEVSYRPSGVSNRFSGSKSGNTASLTISGLQTEDEADYYCGSYRVSSSYVFGTGTKVTVLGQPKANPTVTLFPPSSEELQANKATLVCL

SEQ ID NO: 97 - DNA, 363 bp, Artificial Sequence
  Synthetically generated oligonucleotide
  CDS (1)...(363)
gaagttcaattgttagagtctggtggcggtcttgttcagcctggtggttctttacgtctttcttgcgctgcttccggattcactttctctcgttacaagatgttttgggttcgccaagctcctggtaaaggtttggagtgggtttctgttatctatccttctggtggccctactatgtatgctgactccgttaaaggtcgcttcactatctctagagacaactctaagaatactctctacttgcagatgaacagcttaagggctgaggacactgcagtctactattgtgcgagagggatggtccgtggatatagtggctacgattaccctttcttggactactggggccagggaaccctggtc

SEQ ID NO: 98 - protein, 121 aa, Artificial Sequence
  Synthetically generated peptide
EVQLLESGGGLVQPGGSLRLSCAASGFTFSRYKMFWVRQAPGKGLEWVSVIYPSGGPTMYADSVKGRFTISRDNSKNTLYLQMNSLRAEDTAVYYCARGMVRGYSGYDYPFLDYWGQGTLV

SEQ ID NO: 99 - DNA, 333 bp, Artificial Sequence
  Synthetically generated oligonucleotide
  CDS (1)...(333)
cacagtgcacaagacatccagatgacccagtctccatcttccctgtctgcatctgtaggggacagagtcaccatcacttgccgagcaagtcagaccattagcagctatttaaattggtatcagcagaagccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcgtacgttcggccaagggaccaaggtggaaatcaaa

SEQ ID NO: 100 - protein, 111 aa, Artificial Sequence
  Synthetically generated peptide
HSAQDIQMTQSPSSLSASVGDRVTITCRASQTISSYLNWYQQKPGKAPKLLIYAASSLQSGVPSRFSGSGSGTDFTLTISSLQPEDFATYYCQQSYSTPRTFGQGTKVEIK

SEQ ID NO: 101 - DNA, 386 bp, Artificial Sequence
  Synthetically generated oligonucleotide
  CDS (1)...(384)
gaagttcaattgttagagtctggtggcggtcttgttcagcctggtggttctttacgtctttcttgcgctgcttccggattcactttctctgcttaccagatggtttgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacactgcagtctactattgtgcgagaggcacgcacctcccgggggttgactactggggccagggaaccctggtcaccgtctcaagcgcctccaccaagggcccatcggtcttcccgct

SEQ ID NO: 102 - protein, 128 aa, Artificial Sequence
  Synthetically generated peptide
EVQLLESGGGLVQPGGSLRLSCAASGFTFSAYQMVWVRQAPGKGLEWVSSIYPSGGWTYYADSVKGRFTISRDNSKNTLYLQMNSLRAEDTAVYYCARGTHLPGVDYWGQGTLVTVSSASTKGPSVFP

SEQ ID NO: 103 - DNA, 339 bp, Artificial Sequence
  Synthetically generated oligonucleotide
  CDS (1)...(339)
cacagtgcacaagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcccccatgtacacttttggccaggggaccaagctggagatcaaa

SEQ ID NO: 104 - protein, 113 aa, Artificial Sequence
  Synthetically generated peptide
HSAQDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPMYTFGQGTKLEIK

SEQ ID NO: 105 - DNA, 339 bp, Artificial Sequence
  Synthetically generated oligonucleotide
  CDS (1)...(339)
gaagttcaattgttagagtctggtggcggtcttgttcagcctggtggttctttacgtctttcttgcgctgcttccggattcactttctcttcttacaagatgggttgggttcgccaagctcctggtaaaggtttggagtgggtttcttctatctatccttctggtggctggactcattatgctgactccgttaaaggtcgcttcactatctctagagacaactctaagaatactctctacttgcagatgaacagcttaagggctgaggacactgcagtctactattgtgcaagagtactactacactactttgactactggggccagggaaccctggtc

SEQ ID NO: 106 - protein, 113 aa, Artificial Sequence
  Synthetically generated peptide
EVQLLESGGGLVQPGGSLRLSCAASGFTFSSYKMGWVRQAPGKGLEWVSSIYPSGGWTHYADSVKGRFTISRDNSKNTLYLQMNSLRAEDTAVYYCARVLLHYFDYWGQGTLV

SEQ ID NO: 107 - DNA, 415 bp, Artificial Sequence
  Synthetically generated oligonucleotide
  CDS (1)...(414)
cacagtgcacagagcgtcttgactcagcctgcctccgtgtctgggtctcctggacagtcgatcaccatctcctgcactggaaccagcagtgacgttggtggttataaatatgtctcctggtaccaacagcacccaggcaaagcccccaaactcattatttctgacgtcaataatcggccctcaggggtttctgatcgcttctctggctccaagtctggcaacacggcctccctgaccatctctgggctccaggctgaggacgacggtgattattactgcagttcctacgcaagtagttcctatacaagcagtaccacttgggtgttcggcggggggaccaagctgaccgtcctaggtcagcccaaggctgcccccttggtcactctgttcccaccctcctctgaggagcttcaag

SEQ ID NO: 108 - protein, 138 aa, Artificial Sequence
  Synthetically generated peptide
HSAQSVLTQPASVSGSPGQSITISCTGTSSDVGGYKYVSWYQQHPGKAPKLIISDVNNRPSGVSDRFSGSKSGNTASLTISGLQAEDDGDYYCSSYASSSYTSSTTWVFGGGTKLTVLGQPKAAPLVTLFPPSSEELQ

SEQ ID NO: 109 - DNA, 471 bp, Artificial Sequence
  Synthetically generated oligonucleotide
  CDS (1)...(471)
gaagttcaattgttagagtctggtggcggtcttgttcagcctggtggttctttacgtctttcttgcgctgcttccggattcactttctcttcttacaagatgggttgggttcgccaagctcctggtagaggtttggagtgggtttcttctatctatccttctggtggctggactcattatgctgactccgttaaaggtcgcttcactatctctagagacaactctaagaatactctctacttgcagatgaacagcttaagggctgaggacactgcagtctactattgtgcaagagtactactacactactttgactactggggccagggaaccctggtcaccgtctcaagcgcctccaccaagggcccatcggtcttccccctggcaccctcctccaagagcacctcgggggcacagcggccctgggctgcctggtcaaggactacttcccgcgataccggtgacggtgtc

SEQ ID NO: 110 - protein, 157 aa, Artificial Sequence
  Synthetically generated peptide
EVQLLESGGGLVQPGGSLRLSCAASGFTFSSYKMGWVRQAPGRGLEWVSSIYPSGGWTHYADSVKGRFTISRDNSKNTLYLQMNSLRAEDTAVYYCARVLLHYFDYWGQGTLVTVSSASTKGPSVFPLAPSSKSTSGAQRPWAAWSRTTSRDTGDGV

SEQ ID NO: 111 - DNA, 325 bp, Artificial Sequence
  Synthetically generated oligonucleotide
  CDS (1)...(324)
cagagcgtcttgactcagcctgcctccgtgtctgggtctcctggacagtcgatcaccatctcctgcactggaaccagcagtgacgttggtggttataaatatgtctcctggtaccaacagcacccaggcaaagcccccaaactcattatttctgacgtcaataatcggccctcaggggtttctgatcgcttctctggctccaagtctggcaacacggcctccctgaccatctctgggctccaggctgaggacgacggtgattattactgcagttcctacgcaagtagttcctatacaagcagtaccacttgggtgttcggcgggg

SEQ ID NO: 112 - protein, 108 aa, Artificial Sequence
  Synthetically generated peptide
QSVLTQPASVSGSPGQSITISCTGTSSDVGGYKYVSWYQQHPGKAPKLIISDVNNRPSGVSDRFSGSKSGNTASLTISGLQAEDDGDYYCSSYASSSYTSSTTWVFGG

SEQ ID NO: 113 - DNA, 425 bp, Artificial Sequence
  Synthetically generated oligonucleotide
  CDS (1)...(423)
gaagttcaattgttagagtctggtggcggtcttgttcagcctggtggttctttacgtctttcttgcgctgcttccggattcactttctctatgtacggtatggtttgggttcgccaagctcctggtaaaggtttggagtgggtttctgttatctctccttctggtggcaatactggttatgctgactccgttaaaggtcgcttcactatctctagagacaactctaagaatactctctacttgcaggtgaacagcttaagggctgaggacactgcagtctactattgtgcgagagccccacgtggatacagctatggttactactactggggccagggaaccctggtcaccgtctcaagcgcctccaccaagggcccatcggtcttcccgctagcaccctcctccaagagcacctctgggggcac

SEQ ID NO: 114 - protein, 141 aa, Artificial Sequence
  Synthetically generated peptide
EVQLLESGGGLVQPGGSLRLSCAASGFTFSMYGMVWVRQAPGKGLEWVSVISPSGGNTGYADSVKGRFTISRDNSKNTLYLQVNSLRAEDTAVYYCARAPRGYSYGYYYWGQGTLVTVSSASTKGPSVFPLAPSSKSTSGG

SEQ ID NO: 115 - DNA, 322 bp, Artificial Sequence
  Synthetically generated oligonucleotide
  CDS (1)...(321)
gacatccagatgacccagtctccactctccctgtctgcatctgtaggagacagagtcaccatcacttgccgggcgagtcagggcattggccattatttagcctggtatcagcagaaaccagggaaagttcctaagctcctgatctatactgcatccactttgcaatcaggggtcccatctcggttcagtggcagtggatctgggacagatttcactctcaccatcaacagcctgcagcctgaggatgttgcaacttattactgtcaacagtttaatagttaccctcacaccttcggccaagggacacgactggatattaaac

SEQ ID NO: 116 - protein, 107 aa, Artificial Sequence
  Synthetically generated peptide
DIQMTQSPLSLSASVGDRVTITCRASQGIGHYLAWYQQKPGKVPKLLIYTASTLQSGVPSRFSGSGSGTDFTLTINSLQPEDVATYYCQQFNSYPHTFGQGTRLDIK

SEQ ID NO: 117 - protein, 5 aa, Artificial Sequence
  Synthetically generated peptide
  VARIANT 1: Xaa = Ala, Gly, Ser, Arg
  VARIANT 3: Xaa = Gly, Val, Lys
  VARIANT 5: Xaa = Gly, Ser, Val, Phe
XYXMX

SEQ ID NO: 118 - protein, 5 aa, Artificial Sequence
  Synthetically generated peptide
  VARIANT 1: Xaa = Ala, Gly, Ser, Ile, Met, Arg, His
  VARIANT 3: Xaa = Gly, Val, Met, Lys
  VARIANT 5: Xaa = Gly, Ser, Val, Met, Phe, His
XYXMX

SEQ ID NO: 119 - protein, 5 aa, Artificial Sequence
  Synthetically generated peptide
  VARIANT 1: Xaa = Ala, Gly, Ser, Ile, Met, Arg, Asn, His
  VARIANT 3: Ala, Gly, Thr, Val, Met, Lys, Pro, Gln
  VARIANT 5: Xaa = Ala, Gly, Ser, Thr, Val, Met, Tyr, Trp, Phe, Lys, His
XYXMX

SEQ ID NO: 120 - protein, 17 aa, Artificial Sequence
  Synthetically generated peptide
  VARIANT 1, 8, 10: Xaa = any amino acid
XIYPSGGXTXYADSVKG

SEQ ID NO: 121 - protein, 10 aa, Artificial Sequence
  Synthetically generated peptide
  VARIANT 1: Xaa = Gly, Ser, Val
  VARIANT 3: Xaa = Ser, Tyr
  VARIANT 8: Xaa = Trp, Gln
  VARIANT 10: Xaa = Gly, Tyr
XIXPSGGXTX

SEQ ID NO: 122 - protein, 17 aa, Artificial Sequence
  Synthetically generated peptide
  VARIANT 1: Xaa = Gly, Ser, Val, Trp
  VARIANT 3: Xaa = Ser, Tyr
  VARIANT 8: Xaa = Trp, Gln
  VARIANT 10: Xaa = Gly, Tyr
XIXPSGGXTXYADSVKG

SEQ ID NO: 123 - protein, 10 aa, Artificial Sequence
  Synthetically generated peptide
  VARIANT 1: Xaa = Gly, Ser, Val, Trp
  VARIANT 3: Xaa = Ser, Tyr
  VARIANT 8: Xaa = Ala, Gly, val, Met, Tyr, Trp, Pro, Gln, His
  VARIANT 10: Xaa = Ala, Gly, Ser, Thr, Leu, Val, Met, Tyr, Phe, Lys, His
XIXPSGGXTX

SEQ ID NO: 124 - protein, 5 aa, Artificial Sequence
  Synthetically generated peptide
  VARIANT 2: Xaa = four or five residues
  VARIANT 5: Xaa = Ile or Tyr
VXFDX

SEQ ID NO: 125 - protein, 11 aa, Artificial Sequence
  Synthetically generated peptide
GYGPIAPGLDY

SEQ ID NO: 126 - protein, 18 aa, Artificial Sequence
  Synthetically generated peptide
  VARIANT 1: Xaa = Gly, Val
  VARIANT 5: Xaa = Gly, Tyr, Asp
  VARIANT 7: Xaa = Ser, Asp
XNYYXSXGYGPIAPGLDY

SEQ ID NO: 127 - protein, 18 aa, Artificial Sequence
  Synthetically generated peptide
  VARIANT 1: Xaa = Gly, Val, Asp
  VARIANT 2: Xaa = Ala, Gly, Leu, Asn
  VARIANT 3: Xaa = Leu, Tyr, Arg
  VARIANT 4: Xaa = Gly, Ser, Thr, Leu, Tyr, His
  VARIANT 5: Xaa = Gly, Tyr, Asp
  VARIANT 6: Xaa = Ala, Gly, Ser, Tyr, Phe, Pro
  VARIANT 7: Xaa = Ser, Phe, Asp
  VARIANT 8: Xaa = Ala, Gly, Tyr, Asp
  VARIANT 9: Xaa = Ile, Tyr
  VARIANT 10: Xaa = Gly, Phe, Asp
  VARIANT 11: Xaa = Tyr, Asp, pro
  VARIANT 12: Xaa = Ile, Pro
XXXXXXXXXXXXAPGLDY

SEQ ID NO: 128 - protein, 18 aa, Artificial Sequence
  Synthetically generated peptide
VNYYDSSGYGPIAPGLDY

SEQ ID NO: 129 - protein, 12 aa, Artificial Sequence
  Synthetically generated peptide
  VARIANT 6: Xaa = Ile, Val
  VARIANT 8: Xaa = Ser, Arg
  VARIANT 9: Xaa = Ser, or absent
  VARIANT 12: Xaa = Ala, Asn
RASQSXSXXYLX

SEQ ID NO: 130 - protein, 10 aa, Artificial Sequence
  Synthetically generated peptide
  VARIANT 9: Xaa = any amino acid
RASQSVSSXL

SEQ ID NO: 131 - protein, 11 aa, Artificial Sequence
  Synthetically generated peptide
  VARIANT 6: Xaa = Ile, Val
  VARIANT 8: Xaa = Ser, Arg
  VARIANT 9: Xaa = Ser, Tyr
  VARIANT 10: Xaa  = Leu, Tyr
  VARIANT 11: Xaa = Ala, Leu, Asn
RASQSXSXXXX

SEQ ID NO: 132 - protein, 12 aa, Artificial Sequence
  Synthetically generated peptide
  VARIANT 4: Xaa = Arg, Glu, Gln
  VARIANT 5: Xaa = Gly, Ser, Thr, Arg, Asn
  VARIANT 6: Xaa = Ile, Val
  VARIANT 7: Xaa = gly, Ser, Thr, Ile, Arg, Asn
  VARIANT 8: Xaa = Ser, Thr, Ile, Arg, His
  VARIANT 9: Xaa = Ser, or absent
  VARIANT 10: Xaa = Ser, Tyr, trp, Asn, his
  VARIANT 11: Xaa = Leu, Val
  VARIANT 12: Xaa = Ala, Ser, Asn
RASXXXXXXXXX

SEQ ID NO: 133 - protein, 7 aa, Artificial Sequence
  Synthetically generated peptide
  VARIANT 1, 4: Xaa = any amino acid
XASXRAT

SEQ ID NO: 134 - protein, 7 aa, Artificial Sequence
  Synthetically generated peptide
  VARIANT 1: Xaa = Ala, gly, Asp
  VARIANT 4: Xaa = Ser, Thr, Asn
XASXRAT

SEQ ID NO: 135 - protein, 7 aa, Artificial Sequence
  Synthetically generated peptide
  VARIANT 1: Xaa = Ala, Gly, Asp
  VARIANT 4: Xaa =Ser, Thr, Asn
  VARIANT 5: Xaa = Leu, Arg
  VARIANT 6: Xaa = Ala, glu, Gln
  VARIANT 7: Xaa = Ser, Thr
XASXXXX

SEQ ID NO: 136 - protein, 7 aa, Artificial Sequence
  Synthetically generated peptide
  VARIANT 1: Xaa = Ala, Gly, Thr, Lys, Asp, Glu, His
  VARIANT 4: Xaa = Ser, Thr, Asn
  VARIANT 5: Xaa =Leu, Arg
  VARIANT 6: Xaa = Ala, Val, Glu, Gln
  VARIANT 7: Xaa = Ser, Thr
XASXXXX

SEQ ID NO: 137 - protein, 10 aa, Artificial Sequence
  Synthetically generated peptide
  VARIANT 3: Xaa = Ser, Tyr, Phe, Arg
  VARIANT 4: Xaa = Gly, Ser, Tyr, Asn
  VARIANT 6: Xaa = Ser, Thr, Tyr, Trp
  VARIANT 7: Xaa = Arg, Pro
  VARIANT 8: Xaa = Leu, Trp, Arg
  VARIANT 9: Xaa = Thr, Ile, Tyr
QQXXSXXXXT

SEQ ID NO: 138 - protein, 10 aa, Artificial Sequence
  Synthetically generated peptide
  VARIANT 1: Xaa = Leu, Gln
  VARIANT 3: Xaa = Ser, Tyr, Phe, Arg
  VARIANT 4: Xaa =Gly, Ser, Tyr, Asn
  VARIANT 5: Xaa = Ser, Lys, Asn
  VARIANT 6: Xaa = Ser, Thr, Tyr, Trp
  VARIANT 7: Xaa = Arg, Pro
  VARIANT 8: Xaa = Leu, Trp, Arg
  VARIANT 9: Xaa = Thr, Ile, Tyr
XQXXXXXXXT

SEQ ID NO: 139 - protein, 10 aa, Artificial Sequence
  Synthetically generated peptide
  VARIANT 3: Xaa = Tyr, Arg
  VARIANT 4: Xaa =Gly, Ser
  VARIANT 6: Xaa = Ser, Trp
  VARIANT 9: Xaa = any amino acid or absent
QQXXSXPRXT

SEQ ID NO: 140 - protein, 10 aa, Artificial Sequence
  Synthetically generated peptide
  VARIANT 1, 2: Xaa = Leu, Gln
  VARIANT 3: Xaa =Ser, Tyr, Phe, Arg, Asp
  VARIANT 4: Xaa = Gly, Ser, Tyr, Asn
  VARIANT 5: Xaa = Ser, Thr, Arg, Lys, Asn
  VARIANT 6: Xaa = Ser, Thr, Tyr, Trp, Phe
  VARIANT 7: Xaa = Arg, Pro
  VARIANT 8: Xaa = Ile, Leu, Met, Trp, Arg, His
  VARIANT 9: Xaa = thr, Ile, Tyr
  VARIANT 10: Xaa = Thr, Ile
XXXXXXXXXX

SEQ ID NO: 141 - protein, 10 aa, Artificial Sequence
  Synthetically generated peptide
  VARIANT 1: Xaa = Leu, Gln
  VARIANT 2: Xaa = leu, Arg, Gln
  VARIANT 3: Xaa = Ser, Tyr, Phe, Arg, Asp
  VARIANT 4: Xaa = gly, ser, Tyr, Asn
  VARIANT 5: Xaa = Ala, Ser, Thr, Arg, Lys, Asn
  VARIANT 6: Xaa = Ser, Thr, Tyr, Trp, Phe
  VARIANT 7: Xaa = Ser, Val, Arg, Pro
  VARIANT 8: Xaa = Ser, Thr, Ile, leu, Met, Trp, Arg, His
  VARIANT 9: Xaa = Tyr, Ile, Tyr
  VARIANT 10: Xaa = Ser, thr, Ile
XXXXXXXXXX

SEQ ID NO: 142 - protein, 8 aa, Artificial Sequence
  Synthetically generated peptide
  VARIANT 2: Xaa = any amino acid
  VARIANT 3: Xaa = Asn, Asp
  VARIANT 4: Xaa = Ile, Val
  VARIANT 5: Xaa = Ala, Gly
  VARIANT 6: Xaa = any amino acid (e.g., Gly or Arg)
  VARIANT 7: Xaa = any amino acid (e.g., Tyr or Asn)
  VARIANT 8: Xaa = any amino acid (e.g., Phe, Asn, or Lys)
SXXXXXXX

SEQ ID NO: 143 - protein, 14 aa, Artificial Sequence
  Synthetically generated peptide
  VARIANT 2: Xaa = Gly, Arg
  VARIANT 3: Xaa = Ser, Thr
  VARIANT 5: Xaa = any amino acid
  VARIANT 6: Xaa = Asn, Asp
  VARIANT 7: Xaa = Ile, Val
  VARIANT 8: Xaa = Ala, Gly
  VARIANT 9: Xaa = any amino acid (e.g., Gly or Arg)
  VARIANT 10: Xaa = any amino acid (e.g., Tyr or Asn)
  VARIANT 11: Xaa = any amino acid (e.g., Phe, Asn, or Lys)
  VARIANT 13: Xaa = any amino acid (e.g., aliphatic, e.g., Val or Ala)
TXXSXXXXXXXYXS

SEQ ID NO: 144 - protein, 7 aa, Artificial Sequence
  Synthetically generated peptide
  VARIANT 1: Xaa = Asp, Glu
XVNNRPS

SEQ ID NO: 145 - protein, 7 aa, Artificial Sequence
  Synthetically generated peptide
  VARIANT 1: Xaa = Asp, Glu
  VARIANT 2: Xaa = Val, Asp
  VARIANT 3: Xaa = Ser, Thr, Asp, Asn
  VARIANT 4: Xaa = Tyr, Arg, Asn,p, Asn
XXXXRPS

SEQ ID NO: 146 - protein, 10 aa, Artificial Sequence
  Synthetically generated peptide
  VARIANT 1: Xaa = Ser, Gln
  VARIANT 3: Xaa = Ser, Tyr
  VARIANT 4: Xaa = Ala, Ser, Ile, Asp
  VARIANT 5: Xaa = Gly, Ser, Arg
  VARIANT 6: Xaa = Ser, Thr
  VARIANT 7: Xaa = Ser, Thr, Arg, Asn
  VARIANT 8: Xaa = ser, Thr, Tyr, Arg
  VARIANT 9: Xaa = Ala, Thr, Leu, Tyr
  VARIANT 10: Xaa = Ser, Val, Trp, Gln
XSXXXXXXXX

SEQ ID NO: 147 - protein, 17 aa, Artificial Sequence
  Synthetically generated peptide
  VARIANT 1: Xaa = Gly, Ser, Val, Trp
  VARIANT 3: Xaa = Ser, Tyr
  VARIANT 8: Xaa = Ala, Gly, Val, Met, Tyr, Trp, Pro, Gln, His
  VARIANT 10: Xaa = Ala, Gly, Ser, Thr, Leu, Val, Met, Tyr, Phe, Lys, His
  VARIANT 12: Xaa = Ala, Thr
XIXPSGGXTXYXDSVKG

SEQ ID NO: 148 - protein, 17 aa, Artificial Sequence
  Synthetically generated peptide
  VARIANT 1: Xaa = Gly, Ser, Val
  VARIANT 3: Xaa = Ser, Tyr
  VARIANT 8: Xaa = Trp, Gln
  VARIANT 10: Xaa = Gly, Tyr
  VARIANT 12: Xaa = Ala, Thr
XIXPSGGXTXYXDSVKG

SEQ ID NO: 149 - protein, 4 aa, Artificial Sequence
  Synthetically generated peptide
MYGM

SEQ ID NO: 150 - protein, 18 aa, Artificial Sequence
  Synthetically generated peptide
  VARIANT 8: Xaa = a hydrophilic amino acid, e.g., glutamine or asparagine
  VARIANT 10: Xaa = a small amino acid, e.g., Gly,Ala, Val, or Ser
VISPSGGXTXYADSAVKG

SEQ ID NO: 151 - protein, 5 aa, Artificial Sequence
  Synthetically generated peptide
  VARIANT 3: Xaa = any amino acid or optionally aliphatic, e.g., Ile or Val
QSXSS

SEQ ID NO: 152 - protein, 11 aa, Artificial Sequence
  Synthetically generated peptide
  VARIANT 6: Xaa = any amino acid or optionally aliphatic, e.g., Ile or Val
RASQSXSSYLA

SEQ ID NO: 153 - protein, 6 aa, Artificial Sequence
  Synthetically generated peptide
  VARIANT 3: Xaa = any amino acid or optionally a hydrophilic amino acid, e.g., serine or asparagine
  VARIANT 5: Xaa = any amino acid or optionally aliphatic or small aliphatic, e.g., alanine or valine
ASXRXT

SEQ ID NO: 154 - protein, 7 aa, Artificial Sequence
  Synthetically generated peptide
  VARIANT 4: Xaa = any amino acid or optionally a hydrophilic amino acid, e.g., serine or asparagine
  VARIANT 6: Xaa = any amino acid or optionally aliphatic or small aliphatic, e.g., alanine or valine
DASXRXT

SEQ ID NO: 155 - protein, 7 aa, Artificial Sequence
  Synthetically generated peptide
  VARIANT 4: Xaa = any amino acid or optionally Lys or Ser
QRSXWPR

SEQ ID NO: 156 - protein, 9 aa, Artificial Sequence
  Synthetically generated peptide
  VARIANT 1: Xaa = any amino acid or optionally Leu or Gln
  VARIANT 5: Xaa = any amino acid or optionally Lys or Ser
XQRSXWPRT

SEQ ID NO: 157 - protein, 11 aa, Artificial Sequence
  Synthetically generated peptide
APRGYSYGYYY

SEQ ID NO: 158 - protein, 8 aa, Artificial Sequence
  Synthetically generated peptide
QQFNSYPH

SEQ ID NO: 159 - protein, 107 aa, Artificial Sequence
  The germlined E3 sequence
DIQMTQSPSSLSASVGDRVTITCRASQGIGHYLAWYQQKPGKVPKLLIYTASTLQSGVPSRFSGSGSGTDFTLTISSLQPEDVATYYCQQFNSYPHTFGQGTRLEIK

SEQ ID NO: 160 - protein, 10 aa, Artificial Sequence
  Synthetically generated peptide
  VARIANT 1: Xaa = Gly, Ser, Val
  VARIANT 3: Xaa = Ser, Tyr
  VARIANT 8: Xaa = Trp, Asn, Gln
  VARIANT 10: Xaa = Gly, Tyr
XIXPSGGXTX

SEQ ID NO: 161 - protein, 9 aa, Artificial Sequence
  Synthetically generated peptide
  VARIANT 3: Xaa = Ser, Tyr, Phe, Arg
  VARIANT 4: Xaa = Gly, Ser, Tyr, Asn
  VARIANT 6: Xaa = Ser, Thr,Tyr, Trp
  VARIANT 7: Xaa = Arg. Pro
  VARIANT 8: Xaa = Leu, Trp, Arg, His
  VARIANT 9: Xaa = Thr, Ile, Tyr
QQXXSXXXX

SEQ ID NO: 162 - protein, 1124 aa, Homo sapiens
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIPRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATIIQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 163 - protein, 497 aa, Homo sapiens
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 164 - protein, 110 aa, ARTIFICIAL
  Antibody
QSELTQPPSASGTPGQRVTISCSGSSSSIGLNPVNWYQQLPGTAPKVVIHSNDQRPSGVPDRFSGSKSGTSASLAISGLQSEDEADYYCAAWDDSLNGPAFGGGTKLTVL

SEQ ID NO: 165 - DNA, 331 bp, ARTIFICIAL
  Antibody
cagagcgaattgactcagccaccctcagcgtctgggacccccgggcagagggtcaccatctcttgttctggaagcagctccagcatcggacttaatcctgtaaactggtaccagcagctcccaggaacggcccccaaagtagtcatccatagtaatgatcagcggccctcaggggtccctgaccgattctctggctccaagtctggcacctcagcctccctggccatcagtggactccagtctgaggatgaggctgattattactgtgcagcatgggatgacagcctgaatggtccggcattcggcggagggaccaagctgaccgtcctag

SEQ ID NO: 166 - protein, 117 aa, ARTIFICIAL
  Antibody
EVQLLESGGGLVQPGGSLRLSCAASGFTFSSYVMMWVRQAPGKGLEWVSRIYPSGGITQYADSVKGRFTISRDNSKNTLYLQMNSLRAEDTAVYYCARDVYRAFDIWGQGTMVTVSS

SEQ ID NO: 167 - DNA, 351 bp, ARTIFICIAL
  Antibody
gaagttcaattgttagagtctggtggcggtcttgttcagcctggtggttctttacgtctttcttgcgctgcttccggattcactttctcttcttacgttatgatgtgggttcgccaagctcctggtaaaggtttggagtgggtttctcgtatctatccttctggtggcattactcagtatgctgactccgttaaaggtcgcttcactatctctagagacaactctaagaatactctctacttgcagatgaacagcttaagggctgaggacacggccgtgtattactgtgcaagagatgtctacagggcttttgatatctggggccaagggacaatggtcaccgtctcaagc

SEQ ID NO: 168 - protein, 111 aa, ARTIFICIAL
  Antibody
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPPGGTFGQGTKVEIK

SEQ ID NO: 169 - DNA, 333 bp, Artificial Sequence
  Antibody
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccggggggaacgttcggccaagggaccaaggtggaaatcaaa

SEQ ID NO: 170 - protein, 125 aa, ARTIFICIAL
  Antibody
EVQLLESGGGLVQPGGSLRLSCAASGFTFSSYKMHWVRQAPGKGLEWVSSIYPSGGYTYYADSVKGRFTISRDNSKNTLYLQMNSLRAEDTAVYYCARDSHHFHFWGDYYFLEYWGQGTLVTVSS

SEQ ID NO: 171 - DNA, 375 bp, ARTIFICIAL
  Antibody
gaagttcaattgttagagtctggtggcggtcttgttcagcctggtggttctttacgtctttcttgcgctgcttccggattcactttctcttcttacaagatgcattgggttcgccaagctcctggtaaaggtttggagtgggtttcttctatctatccttctggtggctatacttattatgctgactccgttaaaggtcgcttcactatctctagagacaactctaagaatactctctacttgcagatgaacagcttaagggctgaggacacggccgtatattactgtgcgagagatagccatcatttccatttttggggtgactattattttctagaatactggggccagggaaccctggtcaccgtctcaagc

SEQ ID NO: 172 - protein, 108 aa, ARTIFICIAL
  Antibody
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGGGTKVEIK

SEQ ID NO: 173 - DNA, 324 bp, ARTIFICIAL
  Antibody
caagacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcccactttcggcggagggaccaaggtggagatcaaa

SEQ ID NO: 174 - protein, 125 aa, ARTIFICIAL
  Antibody
EVQLLESGGGLVQPGGSLRLSCAASGFTFSQYLMFWVRQAPGKGLEWVSYIYPSGGWTMYADSVKGRFTISRDNSKNTLYLQMNSLRAEDTAVYYCARQNYYDSSGYYYRGFDYWGQGTLVTVSS

SEQ ID NO: 175 - DNA, 375 bp, ARTIFICIAL
  Antibody
gaagttcaattgttagagtctggtggcggtcttgttcagcctggtggttctttacgtctttcttgcgctgcttccggattcactttctctcagtaccttatgttttgggttcgccaagctcctggtaaaggtttggagtgggtttcttatatctatccttctggtggctggactatgtatgctgactccgttaaaggtcgcttcactatctctagagacaactctaagaatactctctacttgcagatgaacagcttaagggctgaggacacggccgtgtattactgtgcgaggcaaaattactatgatagtagtggttattactatcgtggctttgactactggggccagggaaccctggtcaccgtctcaagc

SEQ ID NO: 176 - protein, 109 aa, ARTIFICIAL
  Antibody
DIHMTQSPATLSLSPGERATLSCRASQSVSSYLAWYQQKPGQAPRLLIYDASNRATGIPARFSGSGSGTDFTLTISSLEPEDFAVYYCQQRSNWPPGITFGGGTKVEIK

SEQ ID NO: 177 - DNA, 327 bp, ARTIFICIAL
  Antibody
gacatccatatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccggggatcactttcggcggagggaccaaggtggagatcaaa

SEQ ID NO: 178 - protein, 117 aa, ARTIFICIAL
  Antibody
EVQLLESGGGLVQPGGSLRLSCAASGFTFSSYKMGWVRQAPGKGLEWVSSIYPSGGWTHYADSVKGRFTISRDNSKNTLYLQMNSLRAEDTAVYYCARVLLHYFDYWGQGTLVTVSS

SEQ ID NO: 179 - DNA, 351 bp, ARTIFICIAL
  Antibody
gaagttcaattgttagagtctggtggcggtcttgttcagcctggtggttctttacgtctttcttgcgctgcttccggattcactttctcttcttacaagatgggttgggttcgccaagctcctggtaaaggtttggagtgggtttcttctatctatccttctggtggctggactcattatgctgactccgttaaaggtcgcttcactatctctagagacaactctaagaatactctctacttgcagatgaacagcttaagggctgaggacactgcagtctactattgtgcaagagtactactacactactttgactactggggccagggaaccctggtcaccgtctcaagc

SEQ ID NO: 180 - protein, 108 aa, ARTIFICIAL
  Antibody
QDIQMTQSPSFLSASVGDRVTISCRASQYISIYLNWYQQRPGEAPKLLINAASSLQSGDPSRFSGSGSGTDFTLTINSLQPDDFATYYCQQYKSYPLTFGEGTKVEIK

SEQ ID NO: 181 - DNA, 324 bp, ARTIFICIAL
  Antibody
caagacatccagatgacccagtctccatccttcctgtccgcatctgtaggagacagagtcaccatctcttgccgggcaagtcagtacatcagcatatatttgaattggtatcagcagagaccaggggaagcccctaaactcctgatcaatgctgcatccagtttgcaaagtggggacccatcaaggttcagtggcagtggatctgggacagatttcactctcaccatcaacagcctgcagcctgatgattttgcaacttattactgccaacagtataagagttaccccctcactttcggcgaggggaccaaggtggagatcaaa

SEQ ID NO: 182 - protein, 118 aa, ARTIFICIAL
  Antibody
EVQLLESGGGLVQPGGSLRLSCAASGFTFSAYGMGWVRQAPGKGLEWVSVISPSGGQTSYADSVKGRFTISRDNSKNTLYLQMNSLRAEDTALYYCAGGDRYGPLHYWGQGTLVTVSS

SEQ ID NO: 183 - DNA, 354 bp, ARTIFICIAL
  Antibody
gaagttcaattgttagagtctggtggcggtcttgttcagcctggtggttctttacgtctttcttgcgctgcttccggattcactttctctgcttacggtatgggttgggttcgccaagctcctggtaaaggtttggagtgggtttctgttatctctccttctggtggccagacttcttatgctgactccgttaaaggtcgcttcactatctctagagacaactctaagaatactctctacttgcagatgaacagcttaagggctgaggacaccgccttgtattactgtgcgggaggggacaggtatggacccttgcactactggggccagggaaccctggtcaccgtctcaagc

SEQ ID NO: 184 - protein, 108 aa, ARTIFICIAL
  Antibody
QDIQMTQSPSSLSASVGDRVTITCQASQDISNYLNWYQQKPGKAPKLLIYHASNLETGVPSRFSGSGSGTDFTLTISSLQPEDFATYYCLQYKSYPRLFGQGTKVEVK

SEQ ID NO: 185 - DNA, 324 bp, ARTIFICIAL
  Antibody
caagacatccagatgacccagtctccatcctccctgtctgcatctgtaggagacagagtcaccatcacttgccaggcgagtcaggacattagcaactatttaaattggtatcagcagaaaccagggaaagcccctaagctcctgatctaccatgcatccaatttggaaacaggggtcccatcaaggttcagtggaagtggatctgggacagatttcactctcaccatcagcagtctgcaacctgaagattttgcaacttattactgtcttcagtataaaagttaccctcgattgttcggccaagggaccaaggtggaagtcaaa

SEQ ID NO: 186 - protein, 122 aa, ARTIFICIAL
  Antibody
EVQLLESGGGLVQPGGSLRLSCAASGFTFSNYKMNWVRQAPGKGLEWVSVIYPSGGWTYYADSVKGRFTISRDNSKNTLYLQMNSLRAEDTAVYYCASGYYDSSGYSRFDYWGQGTLVTVSS

SEQ ID NO: 187 - DNA, 366 bp, ARTIFICIAL
  Antibody
gaagttcaattgttagagtctggtggcggtcttgttcagcctggtggttctttacgtctttcttgcgctgcttccggattcactttctctaattacaagatgaattgggttcgccaagctcctggtaaaggtttggagtgggtttctgttatctatccttctggtggctggacttattatgctgactccgttaaaggtcgcttcactatctctagagacaactctaagaatactctctacttgcagatgaacagcttaagggctgaggacacggctgtgtattactgtgcgagtggttactatgatagtagtggttactcccgatttgactactggggccagggaaccctggtcaccgtctcaagc

SEQ ID NO: 188 - protein, 110 aa, ARTIFICIAL
  Antibody
QSALTQPASVSGSPGQSITISCTGTSSDVGSYNLVSWYQQHPGKAPQLMIYEGSKRPSGLSNRFSGSKSDNTASLTISGLQAEDEADYYCCSYAGSSTLVFGGGTKLTVL

SEQ ID NO: 189 - DNA, 330 bp, ARTIFICIAL
  Antibody
cagagcgctttgactcagcctgcctccgtgtctgggtctcctggacagtcgatcaccatctcctgcactggaaccagcagtgatgttgggagttataaccttgtctcctggtaccaacaacacccaggcaaagccccccaactcatgatttatgagggcagtaagcggccctcaggactttctaatcgcttctctggctccaagtctgacaacacggcctccctgacaatctctgggctccaggctgaggacgaggctgattattactgctgctcatatgcaggtagtagcactttagtattcggcggagggaccaagctgaccgtccta

SEQ ID NO: 190 - protein, 117 aa, ARTIFICIAL
  Antibody
EVQLLESGGGLVQPGGSLRLSCAASGFTFSRYKMGWVRQAPGKGLEWVSSIYPSGGPTYYADSVKGRFTISRDNSKNTLYLQMNSLRAEDTAMYYCARSEVGAPDYWGQGTLVTVSS

SEQ ID NO: 191 - DNA, 351 bp, ARTIFICIAL
  Antibody
gaagttcaattgttagagtctggtggcggtcttgttcagcctggtggttctttacgtctttcttgcgctgcttccggattcactttctctcgttacaagatgggttgggttcgccaagctcctggtaaaggtttggagtgggtttcttctatctatccttctggtggccctacttattatgctgactccgttaaaggtcgcttcactatctctagagacaactctaagaatactctctacttgcagatgaacagcttaagggctgaggacacagccatgtattactgtgcgagaagcgaagtgggagcccccgactactggggccagggaaccctggtcaccgtctcaagc

SEQ ID NO: 192 - protein, 108 aa, ARTIFICIAL
  Antibody
QDIQMTQSPSTLSASVGDTVTMTCRASQSISGWLAWYQQKPGKAPNLLIFKASTLKSGVPSRFRGSGSGTEFTLTISSLQPDDFATYYCQQYNSYSQTFGQGTKVEIK

SEQ ID NO: 193 - DNA, 324 bp, ARTIFICIAL
  Antibody
caagacatccagatgacccagtctccttccaccctttctgcatctgtaggagacaccgtcaccatgacttgccgggccagtcagagtattagtgggtggttggcctggtatcagcagaaaccagggaaagcccctaacctcctgatctttaaggcgtctactttaaaaagtggggtcccgtcaaggtttcgcggcagtggatctgggacagaattcactctcaccatcagcagcctgcagcctgatgattttgcaacttattactgccaacaatataatagttattctcagacgttcggccaagggaccaaggtggaaatcaaa

SEQ ID NO: 194 - protein, 121 aa, ARTIFICIAL
  Antibody
EVQLLESGGGLVQPGGSLRLSCAASGFTFSMYKMHWVRQAPGKGLEWVSSIYPSGGYTVYADSVKGRFTISRDNSKNTLYLQMNSLRAEDTAVYYCATDRWSSGGYGVDFWGQGTLVTVSS

SEQ ID NO: 195 - DNA, 363 bp, ARTIFICIAL
  Antibody
gaagttcaattgttagagtctggtggcggtcttgttcagcctggtggttctttacgtctttcttgcgctgcttccggattcactttctctatgtacaagatgcattgggttcgccaagctcctggtaaaggtttggagtgggtttcttctatctatccttctggtggctatactgtttatgctgactccgttaaaggtcgcttcactatctctagagacaactctaagaatactctctacttgcagatgaacagcttaagggctgaggacacggccgtgtattactgtgccacagaccggtggagcagtggcgggtacggtgttgacttctggggccagggaaccctggtcaccgtctcaagc

SEQ ID NO: 196 - protein, 112 aa, ARTIFICIAL
  Antibody
QDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPQFGQGTKVEIK

SEQ ID NO: 197 - DNA, 336 bp, ARTIFICIAL
  Antibody
caagacatccagatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcagttcggccaagggaccaaggtggaaatcaag

SEQ ID NO: 198 - protein, 118 aa, ARTIFICIAL
  Antibody
EVQLLESGGGLVQPGGSLRLSCAASGFTFSHYDMSWVRQAPGKGLEWVSYIYPSGGPTYYADSVKGRFTISRDNSKNTLYLQMNSLRAEDTAVYYCARGDWASRFATWGQGTTVTVSS

SEQ ID NO: 199 - DNA, 354 bp, ARTIFICIAL
  Antibody
gaagttcaattgttagagtctggtggcggtcttgttcagcctggtggttctttacgtctttcttgcgctgcttccggattcactttctctcattacgatatgtcttgggttcgccaagctcctggtaaaggtttggagtgggtttcttatatctatccttctggtggccctacttattatgctgactccgttaaaggtcgcttcactatctctagagacaactctaagaatactctctacttgcagatgaacagcttaagggctgaggacacggccgtgtattactgtgcaagaggcgattgggcttctcgttttgccacctggggccaggggaccacggtcaccgtctcaagc

SEQ ID NO: 200 - protein, 108 aa, ARTIFICIAL
  Antibody
QYELTQPPSVSVAPGQTARITCGGNNIGIKSVNWYQQKPGQAPVLVVYDDSGRPSGIPQRFSGSNSGNTATLTINRVEAGDEADYYCQVWDSGSDHWVFGGGTKLTVL

SEQ ID NO: 201 - DNA, 324 bp, ARTIFICIAL
  Antibody
cagtacgaattgactcagccaccctcggtgtcagtggccccaggacagacggccaggattacctgtgggggaaacaacattggaattaaaagtgtgaactggtaccagcagaagccaggccaggcccctgtgctggtcgtctatgatgatagtggccggccctcagggatccctcagcgattctctggctccaactctgggaacacggccaccctgaccatcaacagggtcgaagccggggatgaggccgactattactgtcaggtgtgggatagtggtagtgatcattgggtgttcggcggagggaccaagctgaccgtccta

SEQ ID NO: 202 - protein, 121 aa, ARTIFICIAL
  Antibody
EVQLLESGGGLVQPGGSLRLSCAASGFTFSHYKMGWVRQAPGKGLEWVSSIYPSGGFTRYADSVKGRFTISRDNSKNTLYLQMNSLRAEDTAVYYCARNFVESSHYYHDYWGQGTLVTVSS

SEQ ID NO: 203 - DNA, 363 bp, ARTIFICIAL
  Antibody
gaagttcaattgttagagtctggtggcggtcttgttcagcctggtggttctttacgtctttcttgcgctgcttccggattcactttctctcattacaagatgggttgggttcgccaagctcctggtaaaggtttggagtgggtttcttctatctatccttctggtggctttactcgttatgctgactccgttaaaggtcgcttcactatctctagagacaactctaagaatactctctacttgcagatgaacagcttaagggctgaggacacggccgtgtattactgtgccagaaatttcgttgaaagtagtcattattaccatgactattggggccagggaaccctggtcaccgtctcaagc

SEQ ID NO: 204 - protein, 108 aa, ARTIFICIAL
  Antibody
QSELTQPPSVSVAPGQTAVITCGGSNIGGKSVHWYQQKSGQAPVLVVFDDRDRPSGIPERFSGSNSGNTATLTITRVEVGDEADYYCQVWDSGTDHRVFGGGTRLTAL

SEQ ID NO: 205 - DNA, 324 bp, ARTIFICIAL
  Antibody
cagagcgaattgactcagccaccctcggtgtcagtggccccagggcagacggccgtgattacctgtggggggagcaacattggaggtaaaagtgtacactggtaccagcagaagtcaggccaggcccctgtgctggtcgtctttgatgatcgcgaccggccctcagggatccctgagcgattctctggctccaactccgggaacacggccaccctgaccatcaccagggtcgaagtcggggatgaggccgactattactgtcaggtgtgggatagtggaactgatcatcgggtgttcggcggagggaccaggctgaccgcccta

SEQ ID NO: 206 - protein, 118 aa, ARTIFICIAL
  Antibody
EVQLLESGGGLVQPGGSLRLSCAASGFTFSRYVMFWVRQAPGKGLEWVSGIYPSGGHTRYADSVKGRFTISRDNSKNTLYLQMNSLRAEDTAVYYCARRGSGGYFDYWGQGTLVTVSS

SEQ ID NO: 207 - DNA, 354 bp, ARTIFICIAL
  Antibody
gaagttcaattgttagagtctggtggcggtcttgttcagcctggtggttctttacgtctttcttgcgctgcttccggattcactttctctcgttacgttatgttttgggttcgccaagctcctggtaaaggtttggagtgggtttctggtatctatccttctggtggccatactcgttatgctgactccgttaaaggtcgcttcactatctctagagacaactctaagaatactctctacttgcagatgaacagcttaagggctgaggacacggccgtgtattactgtgcgagacgaggctcggggggctactttgactactggggccagggcaccctggtcaccgtctcaagc

SEQ ID NO: 208 - protein, 107 aa, ARTIFICIAL
  Antibody
QSALTQDPAVSVALGQTVRITCRGDRLRSYYSSWYQQKPRQAPVLVMFGRNNRPSGIPDRFSGSTSGSTASLTITATQADDEADYFCSSRDGSGNFLFGGGTKLTVL

SEQ ID NO: 209 - DNA, 321 bp, ARTIFICIAL
  Antibody
cagagcgctttgactcaggaccctgctgtgtctgtggccttggggcagacagtcaggatcacatgccgaggagacagactcagaagttattattcaagttggtaccagcagaagccacgacaggcccctgttcttgtcatgtttggtagaaacaaccggccctcagggatcccagaccgattctctggctccacctcaggaagcacagcttccttgaccatcactgcgactcaggcggacgatgaggctgactatttctgtagttcccgggacggcagtggtaatttcctcttcggcggagggaccaaactgaccgtcctt

SEQ ID NO: 210 - protein, 124 aa, ARTIFICIAL
  Antibody
EVQLLESGGGLVQPGGSLRLSCAASGFTFSRYKMIWVRQAPGKGLEWVSSIYPSGGTTSYADSVKGRFTISRDNSKNTLYLQMNSLRAEDTAVYYCARSDLGSGWYSAEYFQHWGQGTLVTVSS

SEQ ID NO: 211 - DNA, 372 bp, ARTIFICIAL
  Antibody
gaagttcaattgttagagtctggtggcggtcttgttcagcctggtggttctttacgtctttcttgcgctgcttccggattcactttctctcgttacaagatgatttgggttcgccaagctcctggtaaaggtttggagtgggtttcttctatctatccttctggtggcactacttcttatgctgactccgttaaaggtcgcttcactatctctagagacaactctaagaatactctctacttgcagatgaacagcttaagggctgaggacacggctgtgtattactgtgcgagaagcgacctaggcagtggctggtatagcgctgaatacttccagcactggggccagggcaccctggtcaccgtctcaagc

SEQ ID NO: 212 - protein, 110 aa, ARTIFICIAL
  Antibody
QDIQMTQSPGTLSLSPGERATLSCRASQSVSGNLLAWYQQKPGQAPRLLIYGASSRATGIPDRFSGSGSGTDFTLTITRLEPEDFAVYFCQQYGGSPPVTFGGGTKVEIK

SEQ ID NO: 213 - DNA, 330 bp, ARTIFICIAL
  Antibody
caagacatccagatgacccagtctccaggcaccctgtctttgtctccaggggaaagagccaccctctcctgcagggccagtcagagtgttagcggcaacctcttagcctggtatcagcagaaacctggccaggctcccagactcctcatctatggtgcatccagcagggccactggcatcccagacaggttcagtggcagtgggtctgggacagacttcactctcaccatcaccagactggagcctgaagattttgcagtgtatttctgtcagcagtatggtggctcacctccggtcactttcggcggagggaccaaggtggagatcaaa

SEQ ID NO: 214 - protein, 125 aa, ARTIFICIAL
  Antibody
EVQLLESGGGLVQPGGSLRLSCAASGFTFSSYLMIWVRQAPGKGLEWVSRIYPSGGGTEYADSVKGRFTISRDNSKNTLYLQMNSLRAEDTAVYYCARVTYYYDSSGYQPAFDIWGQGTMVTVSS

SEQ ID NO: 215 - DNA, 375 bp, ARTIFICIAL
  Antibody
gaagttcaattgttagagtctggtggcggtcttgttcagcctggtggttctttacgtctttcttgcgctgcttccggattcactttctcttcttaccttatgatttgggttcgccaagctcctggtaaaggtttggagtgggtttctcgtatctatccttctggtggcggtactgagtatgctgactccgttaaaggtcgcttcactatctctagagacaactctaagaatactctctacttgcagatgaacagcttaagggctgaggacacggccgtgtattactgtgcgagagtcacgtattactatgatagtagtggttatcaacccgcttttgatatctggggccaagggacaatggtcaccgtctcaagc

SEQ ID NO: 216 - protein, 108 aa, ARTIFICIAL
  Antibody
QDIQMTQSPATLSLSPGERATLSCRASQSVSSYLAWYQQKPGQAPRLLIYDASNRATGIPARFSGSGSGTDFTLIISSLEPEDFAVYYCQQRSNWPRTFGQGTKVEIK

SEQ ID NO: 217 - DNA, 324 bp, ARTIFICIAL
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcatcatcagcagcctagagcctgaagattttgcagtttattattgtcagcagcgtagcaactggcctcgaacgttcggccaagggaccaaggtggaaatcaaa

SEQ ID NO: 218 - protein, 116 aa, ARTIFICIAL
  Antibody
EVQLLESGGGLVQPGGSLRLSCAASGFTFSHYGMTWVRQAPGKGLEWVSVIGPSGGNTMYADSVKGRFTISRDNSKNTLYLQMNSLRAEDTAVYYCARVWGAFDIWGQGTMVTVSS

SEQ ID NO: 219 - DNA, 348 bp, ARTIFICIAL
  Antibody
gaagttcaattgttagagtctggtggcggtcttgttcagcctggtggttctttacgtctttcttgcgctgcttccggattcactttctctcattacggtatgacttgggttcgccaagctcctggtaaaggtttggagtgggtttctgttatcggtccttctggtggcaatactatgtatgctgactccgttaaaggtcgcttcactatctctagagacaactctaagaatactctctacttgcagatgaacagcttaagggctgaggacacggccgtgtattactgtgcgagagtatggggtgcttttgatatctggggccaagggacaatggtcaccgtctcaagc

SEQ ID NO: 220 - protein, 109 aa, ARTIFICIAL
  Antibody
QDIQMTQSPATLSVSPGERATLSCRASQSVYNNLAWYQQKPGQAPRLLIYDASTTATGIPARFSGSGSGTDFTLTITSLEPEDFAVYYCQQRSNWPSLTFGGGTKVEIK

SEQ ID NO: 221 - DNA, 327 bp, ARTIFICIAL
  Antibody
caagacatccagatgacccagtctccagccaccctgtctgtgtctccaggggaacgagccaccctctcctgcagggccagtcagagtgtttacaacaacttagcctggtaccaacagaaacctggccaggctcccaggctcctcatctatgatgcatccaccacggccactggcatcccagccaggttcagtggcagtgggtctgggacagacttcactctcaccatcaccagcctagagcctgaagattttgcagtttattactgtcagcagcgtagcaactggccctcgctcactttcggcggagggaccaaggtggagatcaaa

SEQ ID NO: 222 - protein, 117 aa, ARTIFICIAL; identical to SEQ ID NO: 178
  Antibody

SEQ ID NO: 223 - DNA, 351 bp, ARTIFICIAL; identical to SEQ ID NO: 179
  Antibody

SEQ ID NO: 224 - protein, 105 aa, ARTIFICIAL
  Antibody
QDIQMTQSPSFLSASLGDRVTITCRATQGIGTFLAWYQQKAGRAPKLLIYGASTLQSGVPSRFSGSGSGTEFTLTISSLQPEDFATYYCQQPNSFFGQGTKLEIK

SEQ ID NO: 225 - DNA, 315 bp, ARTIFICIAL
  Antibody
caagacatccagatgacccagtctccatccttcctgtctgcatctttaggagacagagtcaccatcacttgtcgggccactcagggcatcggcacttttttagcctggtatcagcaaaaagcagggagagcccctaaactcctgatctatggtgcttccactttgcagagtggggtcccatcaaggttcagcggcagtggatctgggacagaattcactctcacaataagcagcctgcagcctgaagattttgcaacttattactgtcaacagcctaatagtttttttgggcaggggaccaagctggagatcaaa

SEQ ID NO: 226 - protein, 117 aa, ARTIFICIAL; identical to SEQ ID NO: 178
  Antibody

SEQ ID NO: 227 - DNA, 351 bp, ARTIFICIAL; identical to SEQ ID NO: 179
  Antibody

SEQ ID NO: 228 - protein, 108 aa, ARTIFICIAL
  Antibody
QDIQMTQSPSSVSASVGDRVTITCRASQDISSWLVWYQQKPGKAPKLLIHDASNLQSGVPSRFSGSGSGTDFTLTINSLQPEDFATYYCQQANSFPVTFGGGTKVEIK

SEQ ID NO: 229 - DNA, 324 bp, ARTIFICIAL
  Antibody
caagacatccagatgacccagtctccatcttccgtgtctgcatctgtaggagacagagtcaccattacttgtcgggcgagtcaggatattagcagttggttagtctggtatcagcagaaaccagggaaagcccctaagctcctgatccatgatgcatccaatttgcaaagtggggtcccatcaaggttcagcggcagtgggtctgggacagattttactctcaccatcaacagcctgcagcctgaagattttgcaacttactattgtcaacaggctaacagtttcccggtcactttcggcggagggaccaaggtggagatcaaa

SEQ ID NO: 230 - protein, 120 aa, ARTIFICIAL
  Antibody
EVQLLESGGGLVQPGGSLRLSCAASGFTFSAYPMLWVRQAPGKGLEWVSSISPSGGATAYADSVKGRFTISRDNSKNTLYLQMNSLRAEDTAVYYCAKGSYSDYGVFESWGQGTLVTVSS

SEQ ID NO: 231 - DNA, 360 bp, ARTIFICIAL
  Antibody
gaagttcaattgttagagtctggtggcggtcttgttcagcctggtggttctttacgtctttcttgcgctgcttccggattcactttctctgcttaccctatgctttgggttcgccaagctcctggtaaaggtttggagtgggtttcttctatctctccttctggtggcgctactgcttatgctgactccgttaaaggtcgcttcactatctctagagacaactctaagaatactctctacttgcagatgaacagcttaagggctgaggacacggccgtgtattactgtgcgaaaggctcatacagtgattacggggtctttgagtcctggggccagggaaccctggtcaccgtctcaagc

SEQ ID NO: 232 - protein, 110 aa, ARTIFICIAL
  Antibody
QRVLTQPPSASGTPGQRVTISCSGSSSNVGSNNVNWYQQLPGQAPKLLIDSNNHRPSGVPDRFSGSKSGTSASLALSGLQSEDEADYYCATWDDNLIAPVFGGGTKLTVL

SEQ ID NO: 233 - DNA, 330 bp, ARTIFICIAL
  Antibody
cagagggtcttgactcagccaccctcagcgtctgggacccccgggcagagggtcaccatctcctgttctggaagcagctccaatgtcggaagtaataatgtaaactggtatcagcagctcccaggacaggcccccaaactcctcatcgatagtaataatcaccggccctcaggggtccctgaccgattctctggctccaagtctggcacctcagcctccctggccctcagtgggctccagtctgaggatgaggctgattattattgtgcgacatgggacgacaacctgattgccccggtattcggcggagggaccaagctgaccgtccta

SEQ ID NO: 234 - protein, 128 aa, ARTIFICIAL
  Antibody
EVQLLESGGGLVQPGGSLRLSCAASGFTFSRYRMSWVRQAPGKGLEWVSGIVPSGGWTTYADSVKGRFTISRDNSKNTLYLQMNSLRAEDTAVYYCARDNYYDFWSGYYISRFGMDVWGQGTTVTVSS

SEQ ID NO: 235 - DNA, 384 bp, ARTIFICIAL
  Antibody
gaagttcaattgttagagtctggtggcggtcttgttcagcctggtggttctttacgtctttcttgcgctgcttccggattcactttctctcgttaccgtatgtcttgggttcgccaagctcctggtaaaggtttggagtgggtttctggtatcgttccttctggtggctggactacttatgctgactccgttaaaggtcgcttcactatctctagagacaactctaagaatactctctacttgcagatgaacagcttaagggctgaggacactgcagtctactattgtgcgagagataactattacgatttttggagtggttattatatttctcgattcggtatggacgtctggggccaagggaccacggtcaccgtctcaagc

SEQ ID NO: 236 - protein, 110 aa, ARTIFICIAL
  Antibody
QYELTQPASVSGSPGQSITISCTGSSSDVSGYNYVSWYQHHPGKAPKLMLYDVSNRPSGVSNRFSGSKSGNTASLTISGLQAEDEADYYCSSYTSSSTWVFGGGTKLTVL

SEQ ID NO: 237 - DNA, 330 bp, ARTIFICIAL
  Antibody
cagtacgaattgactcagcctgcctccgtgtctgggtctcctggacagtcgatcaccatctcctgcactggatccagcagtgacgttagtggttataactatgtctcctggtaccaacaccacccaggcaaagcccccaaactcatgctttatgatgtcagtaatcggccctcaggggtttctaatcgcttctctggctccaagtctggcaacacggcctccctgaccatctctgggctccaggctgaggacgaggctgattattactgcagctcatatacaagcagcagcacttgggtgttcggcggagggaccaagctgaccgtccta

SEQ ID NO: 238 - protein, 123 aa, ARTIFICIAL
  Antibody
EVQLLESGGGLVQPGGSLRLSCAASGFTFSSYMMFWVRQAPGKGLEWVSRIYPSGGWTYYADSVKGRFTISRDNSKNTLYLQMNSLRAEDTAVYYCARVTVPLDSGSYYFDYWGQGTLVTVSS

SEQ ID NO: 239 - DNA, 369 bp, ARTIFICIAL
  Antibody
gaagttcaattgttagagtctggtggcggtcttgttcagcctggtggttctttacgtctttcttgcgctgcttccggattcactttctcttcttacatgatgttttgggttcgccaagctcctggtaaaggtttggagtgggtttctcgtatctatccttctggtggctggacttattatgctgactccgttaaaggtcgcttcactatctctagagacaactctaagaatactctctacttgcagatgaacagcttaagggctgaggacacggccgtgtattactgtgcgagagttacggtaccccttgatagtgggagctactactttgactactggggccagggaaccctggtcaccgtctcaagc

SEQ ID NO: 240 - protein, 108 aa, ARTIFICIAL
  Antibody
QDIQMTQSPSSLSASVGDRVTITCRASQGIRNDLGWYQQKPGKAPKLLIYAASSLQSGVPSRFSGSGSGTDFTLTISSLQPEDFATYYCLQDYNYPWTFGQGTNVEIK

SEQ ID NO: 241 - DNA, 324 bp, ARTIFICIAL
  Antibody
caagacatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattacccgtggacgttcggccaagggaccaatgtggaaatcaaa

SEQ ID NO: 242 - protein, 125 aa, ARTIFICIAL
  Antibody
EVQLLESGGGLVQPGGSLRLSCAASGFTFSSYLMTWVRQAPGKGLEWVSSIYPSGGWTYYADSVKGRFTISRDNSKNTLYLQMNSLRAEDTATYYCAREMYYDFWSGYYRGFDIWGQGTTVTVSS

SEQ ID NO: 243 - DNA, 375 bp, ARTIFICIAL
  Antibody
gaagttcaattgttagagtctggtggcggtcttgttcagcctggtggttctttacgtctttcttgcgctgcttccggattcactttctcttcttaccttatgacttgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacacagccacatattactgtgcgagagagatgtattacgatttttggagtggttattatcgaggttttgatatctggggccaagggaccacggtcaccgtctcaagc

SEQ ID NO: 244 - protein, 108 aa, ARTIFICIAL
  Antibody
QDIQMTQSPSTLSASIGDRVTITCRASQRVSTWVAWYQQKPGRAPKLLIYMASRLESGVPSRFSGSGSGTEFTLTISSLQPDDFATYWCQQYNFYPRTFGQGTKVDIK

SEQ ID NO: 245 - DNA, 324 bp, ARTIFICIAL
  Antibody
caagacatccagatgacccagtctccttccaccctgtctgcatctataggagacagagtcaccatcacttgccgggccagtcagcgtgttagtacttgggtggcctggtatcagcagaaaccagggagagccccaaaactcttgatctatatggcgtctaggttagaaagtggggtcccatcaaggttcagcggcagtggatctgggacagagttcactctcaccataagcagcctgcagcctgatgattttgctacttattggtgccaacaatataatttttatcctcggacgttcggccaagggaccaaggtggacatcaaa

SEQ ID NO: 246 - protein, 119 aa, ARTIFICIAL
  Antibody
EVQLLESGGGLVQPGGSLRLSCAASGFTFSWYGMNWVRQAPGKGLEWVSSISPSGGQTPYADSVKGRFTISRDNSKNTLYLQMNSLRAEDTAVYYCARDLGGAYIPDSWGQGTLVTVSS

SEQ ID NO: 247 - DNA, 357 bp, ARTIFICIAL
  Antibody
gaagttcaattgttagagtctggtggcggtcttgttcagcctggtggttctttacgtctttcttgcgctgcttccggattcactttctcttggtacggtatgaattgggttcgccaagctcctggtaaaggtttggagtgggtttcttctatctctccttctggtggccagactccttatgctgactccgttaaaggtcgcttcactatctctagagacaactctaagaatactctctacttgcagatgaacagcttaagggctgaggacacggccgtgtattactgtgcgcgagatctcggtggggcctacatacctgactcctggggccagggcaccctggtcaccgtctcaagc

SEQ ID NO: 248 - protein, 108 aa, ARTIFICIAL
  Antibody
QDIQMTQSPSFLSASVGDRVTITCRASQGISNYLAWYQQEPGKAPKLLIYSASTLQTGVPSRFSGSGSGTEFTLTISSLQPEDFATYYCQQFNSYPRTFGHGTKVEFK

SEQ ID NO: 249 - DNA, 324 bp, ARTIFICIAL
  Antibody
caagacatccagatgacccagtctccttccttcctgtctgcatctgtgggagacagagtcaccatcacttgccgggccagtcagggcattagcaattatttagcctggtatcagcaagaaccagggaaagcccctaagctcctcatctattctgcgtccactttgcaaactggagtcccatcaaggttcagcggcagtggatctgggacagagttcactctcacaatcagcagcctgcagcctgaggattttgcaacttattactgtcaacagtttaacagttaccctcgaacgttcggccacgggaccaaggtggaattcaaa

SEQ ID NO: 250 - protein, 118 aa, ARTIFICIAL
  Antibody
EVQLLESGGGLVQPGGSLRLSCAASGFTFSTYPMMWVRQAPGKGLEWVSVISPSGGQTSYADSVKGRFTISRDNSKNTLYLQMNSLRAEDTAVYYCTRGGRLNAFDIWGQGTMVTVSS

SEQ ID NO: 251 - DNA, 354 bp, ARTIFICIAL
  Antibody
gaagttcaattgttagagtctggtggcggtcttgttcagcctggtggttctttacgtctttcttgcgctgcttccggattcactttctctacttaccctatgatgtgggttcgccaagctcctggtaaaggtttggagtgggtttctgttatctctccttctggtggccagacttcttatgctgactccgttaaaggtcgcttcactatctctagagacaactctaagaatactctctacttgcagatgaacagcttaagggctgaggacacagccgtgtattactgtacgagaggggggaggctgaatgcttttgatatctggggccaagggacaatggtcaccgtctcaagc

SEQ ID NO: 252 - protein, 107 aa, ARTIFICIAL
  Antibody
QSALTQDPAVSVALGQTVRFTCQGDSLRNYHPSWYQQKPGQAPVLVIYGKNNRPSGIPDRFSGSSSGNTASLTITGAQAEDEADYYCNSRDSSGNHVFGTGTKVTVL

SEQ ID NO: 253 - DNA, 321 bp, ARTIFICIAL
  Antibody
cagagcgctttgactcaggaccctgctgtgtctgtggccttgggacagacagtcaggttcacttgccaaggagacagcctcagaaattatcatccaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatgtcttcggaactgggaccaaggtcaccgtccta

SEQ ID NO: 254 - protein, 126 aa, ARTIFICIAL
  Antibody
EVQLLESGGGLVQPGGSLRLSCAASGFTFSIYQMGWVRQAPGKGLEWVSRIYPSGGVTKYADSVKGRFTISRDNSKNTLYLQMNSLRAEDTAVYYCARDFGPGDLWSGYYDAFDIWGQGTMVTVSS

SEQ ID NO: 255 - DNA, 378 bp, ARTIFICIAL
  Antibody
gaagttcaattgttagagtctggtggcggtcttgttcagcctggtggttctttacgtctttcttgcgctgcttccggattcactttctctatttaccagatgggttgggttcgccaagctcctggtaaaggtttggagtgggtttctcgtatctatccttctggtggcgttactaagtatgctgactccgttaaaggtcgcttcactatctctagagacaactctaagaatactctctacttgcagatgaacagcttaagggctgaggacacggctgtgtattactgtgccagagatttcggtccgggcgatttatggagtggttattatgatgcttttgatatctggggccaagggacaatggtcaccgtctcaagc

SEQ ID NO: 256 - protein, 110 aa, ARTIFICIAL
  Antibody
QSALTQPASASGSPGQSVTISCTGTSSDVGGYNYVSWYQQHPGKAPKLMIYEVSKRPSGVPDRFSGSKSATTASLTVSGLQAEDEADYYCSSYAGSNNLIFGGGTKVTVL

SEQ ID NO: 257 - DNA, 330 bp, ARTIFICIAL
  Antibody
cagagcgctttgactcagcctgcctccgcgtccgggtctcctggacagtcagtcaccatctcctgcactggaaccagcagtgacgttggtggttataactatgtctcctggtaccaacaacacccaggcaaagcccccaaactcatgatttatgaggtcagtaagcggccctcaggggtccctgatcgcttctctggctccaagtctgccaccacggcctccctgaccgtctctgggctccaggctgaggatgaggctgattattactgcagctcatatgcaggcagcaacaatttgatattcggcggggggaccaaggtgaccgtccta

SEQ ID NO: 258 - protein, 120 aa, ARTIFICIAL
  Antibody
EVQLLESGGGLVQPGGSLRLSCAASGFTFSSYQMQWVRQAPGKGLEWVSVIYPGGYTYYADSVKGRFTISRDNSKNTLYLQMNSLRAEDTAVYYCARLQFYGSSAAFDIWGQGTMVTVSS

SEQ ID NO: 259 - DNA, 360 bp, ARTIFICIAL
  Antibody
gaagttcaattgttagagtctggtggcggtcttgttcagcctggtggttctttacgtctttcttgcgctgcttccggattcactttctcttcttaccagatgcagtgggttcgccaagctcctggtaaaggtttggagtgggtttctgttatctatcctggtggctatacttattatgctgactccgttaaaggtcgcttcactatctctagagacaactctaagaatactctctacttgcagatgaacagcttaagggctgaggacacggccgtgtattactgtgcaagactccagttctacggttcctctgctgcttttgacatctggggccaagggacaatggtcaccgtctcaagc

SEQ ID NO: 260 - protein, 108 aa, ARTIFICIAL
  Antibody
QDIQMTQSPDTLSLSPGERATLSCRASQSISRYLAWYQQRPGQAPSLLIYDASERAAGIPARFSGSGSGTDFTLTISSLEPEDFAVYYCQQRGNWPLTFGGGTKVDIR

SEQ ID NO: 261 - DNA, 324 bp, ARTIFICIAL
  Antibody
caagacatccagatgacccagtctccagacaccctgtctttgtctccaggggaaagagccaccctctcctgcagggccagtcagagtattagtagatacttagcctggtaccaacaaagacctggccaggctcccagcctcctcatctatgatgcatccgaaagggccgctggcatcccagccaggttcagtggcagtgggtctgggacagacttcactctcaccatcagcagcctggagcctgaagattttgcagtttattactgtcagcaacgtggcaactggccgctcactttcggcggagggaccaaggtggacatcaga

SEQ ID NO: 262 - protein, 119 aa, ARTIFICIAL
  Antibody
EVQLLESGGGLVQPGGSLRLSCAASGFTFSQYPMIWVRQAPGKGLEWVSVISPSGGHTSYADSVKGRFTISRDNSKNTLYLQMNSLRAEDTAVYYCARIQYYGGAFDIWGQGKMVTVSS

SEQ ID NO: 263 - DNA, 357 bp, ARTIFICIAL
  Antibody
gaagttcaattgttagagtctggtggcggtcttgttcagcctggtggttctttacgtctttcttgcgctgcttccggattcactttctctcagtaccctatgatttgggttcgccaagctcctggtaaaggtttggagtgggtttctgttatctctccttctggtggccatacttcttatgctgactccgttaaaggtcgcttcactatctctagagacaactctaagaatactctctacttgcagatgaacagcttaagggctgaggacacggccgtgtattactgtgcgagaatccagtactacggtggggcttttgatatctggggccaagggaaaatggtcaccgtctcaagc

SEQ ID NO: 264 - protein, 108 aa, ARTIFICIAL
  Antibody
QDIQMTQSPATLSLSPGERATLSCRASQSVSSYLAWYQQKPGQAPRLLIYDASNRATGIPARFSGSGSGTDFTLTISSLEPEDFAVYYCQQRSNWPHTFGGGTKVEIK

SEQ ID NO: 265 - DNA, 324 bp, ARTIFICIAL
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcacactttcggcggagggaccaaggtggagatcaaa

SEQ ID NO: 266 - protein, 118 aa, ARTIFICIAL
  Antibody
EVQLLESGGGLVQPGGSLRLSCAASGFTFSPYGMLWVRQAPGKGLEWVSVISPSGGQTFYADSVKGRFTISRDNSKNTLYLQMNSLRAEDTAVYYCARLGAEKGMDVWGQGTTVTVSS

SEQ ID NO: 267 - DNA, 354 bp, ARTIFICIAL
  Antibody
gaagttcaattgttagagtctggtggcggtcttgttcagcctggtggttctttacgtctttcttgcgctgcttccggattcactttctctccttacggtatgctttgggttcgccaagctcctggtaaaggtttggagtgggtttctgttatctctccttctggtggccagactttttatgctgactccgttaaaggtcgcttcactatctctagagacaactctaagaatactctctacttgcagatgaacagcttaagggctgaggacacggccgtgtattactgtgcgaggctaggtgcggaaaaaggtatggacgtctggggccaagggaccacggtcaccgtctcaagc

SEQ ID NO: 268 - protein, 108 aa, ARTIFICIAL
  Antibody
QDIQMTQSPATLSVSPGERATLSCRASQSVSSNLAWYQQRPGQAPRLLIYGASSRATGIPDRFSGSGSGTDFTLTISRLEPEDFAVYYCQQYGSSPRTFGQGTKVEIK

SEQ ID NO: 269 - DNA, 324 bp, ARTIFICIAL
  Antibody
caagacatccagatgacccagtctccagccaccctgtctgtgtctccaggggaaagagccaccctctcctgcagggccagtcagagtgttagcagcaacttagcctggtaccagcagagacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaagggaccaaggtggaaatcaaa

SEQ ID NO: 270 - protein, 130 aa, ARTIFICIAL
  Antibody
EVQLLESGGGLVQPGGSLRLSCAASGFTFSRYVMGWVRQAPGKGLEWVSSIYPSGGYTYYADSVKGRFTISRDNSKNTLYLQMNSLRAEDTAVYYCAKDSPHCSGGSCYGGYYYYGMDVWGQGTTVTVSS

SEQ ID NO: 271 - DNA, 390 bp, ARTIFICIAL
  Antibody
gaagttcaattgttagagtctggtggcggtcttgttcagcctggtggttctttacgtctttcttgcgctgcttccggattcactttctctcgttacgttatgggttgggttcgccaagctcctggtaaaggtttggagtgggtttcttctatctatccttctggtggctatacttattatgctgactccgttaaaggtcgcttcactatctctagagacaactctaagaatactctctacttgcagatgaacagcttaagggctgaggacacggccgtgtattactgtgcgaaagattccccgcattgtagtggtggtagctgctacgggggctactactactacggtatggacgtctggggccaagggaccacggtcaccgtctcaagc

SEQ ID NO: 272 - protein, 110 aa, ARTIFICIAL
  Antibody
QSELTQPASVSGSPGQSITISCTGTNRDVGGYNYVSWYQQHPGKAPKLMIYDVSNRPSGVSNRFSGSKSGNTASLTISGLQADDEAEYYCSSYTSSGTRVFGTGTKVTVL

SEQ ID NO: 273 - DNA, 330 bp, ARTIFICIAL
  Antibody
cagagcgaattgactcagcctgcctccgtgtctgggtctcctggacagtcgatcaccatctcctgcactggaaccaacagagacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgacgacgaggctgagtattactgcagctcatatacaagcagcggcactcgagtcttcggaactgggaccaaggtcaccgtccta

SEQ ID NO: 274 - protein, 117 aa, ARTIFICIAL
  Antibody
EVQLLESGGGLVQPGGSLRLSCAASGFTFSHYIMVWVRQAPGKGLEWVSSIYPSGGVTYYADSVKGRFTISRDNSKNTLYLQMNSLRAEDTAVYYCARDVAGALDYWGQGTLVTVSS

SEQ ID NO: 275 - DNA, 351 bp, ARTIFICIAL
  Antibody
gaagttcaattgttagagtctggtggcggtcttgttcagcctggtggttctttacgtctttcttgcgctgcttccggattcactttctctcattacattatggtttgggttcgccaagctcctggtaaaggtttggagtgggtttcttctatctatccttctggtggcgttacttattatgctgactccgttaaaggtcgcttcactatctctagagacaactctaagaatactctctacttgcagatgaacagcttaagggctgaggacacggccgtgtattactgtgcgagagatgttgccggagctcttgactactggggccagggaaccctggtcaccgtctcaagc

SEQ ID NO: 276 - protein, 110 aa, ARTIFICIAL
  Antibody
QYELTQPASVSGSPGQSITISCTGTSTDVGGYNYVSWYQKHPGKAPKLMIYDVSNRPSGVSNRFSGSKSGNTASLTISGLQAEDEADYYCSSYTNTITVVFGGGTKLTVL

SEQ ID NO: 277 - DNA, 330 bp, ARTIFICIAL
  Antibody
cagtacgaattgactcagcctgcctccgtgtctgggtctcctggacagtcgatcaccatctcctgcactggaaccagcactgacgttggtggttataactatgtctcctggtaccaaaaacacccaggcaaagcccccaaactcatgatttatgatgtcagtaaccggccctctggggtttctaatcgcttctctggctccaagtctggcaacacggcctccctgaccatctctgggctccaggctgaggacgaggctgactattactgcagctcatatacaaacaccatcaccgtggtgttcggcggagggaccaagctgaccgtccta

SEQ ID NO: 278 - protein, 122 aa, ARTIFICIAL
  Antibody
EVQLLESGGGLVQPGGSLRLSCAASGFTFSKYWMHWVRQAPGKGLEWVSSIYSSGGRTHYADSVKGRFTISRDNSKNTLYLQMNSLRAEDTAMYYCAHTDSSTWYRWYFDLWGRGTLVTVSS

SEQ ID NO: 279 - DNA, 366 bp, ARTIFICIAL
  Antibody
gaagttcaattgttagagtctggtggcggtcttgttcagcctggtggttctttacgtctttcttgcgctgcttccggattcactttctctaagtactggatgcattgggttcgccaagctcctggtaaaggtttggagtgggtttcttctatctattcttctggtggccgtactcattatgctgactccgttaaaggtcgcttcactatctctagagacaactctaagaatactctctacttgcagatgaacagcctaagggctgaggacaccgccatgtattactgtgcacacactgatagcagcacctggtaccggtggtacttcgatctctggggccgtggcaccctggtcaccgtctcaagc

SEQ ID NO: 280 - protein, 108 aa, ARTIFICIAL
  Antibody
QDIQMTQSPSTLSSSVGDRVTITCRASQSVSNWLAWYQQKPGKAPKVLIYKASTLESGVPSRFSGSGSGTEFTLTISSLQPDDFATYYCQHYHRYSRTFGQGTKVEIK

SEQ ID NO: 281 - DNA, 324 bp, ARTIFICIAL
  Antibody
caagacatccagatgacccagtctccttccaccctgtcttcatctgtaggagacagagtcaccatcacttgccgggccagtcagagtgttagtaactggttggcctggtatcagcagaaaccagggaaagcccctaaggtcctaatctataaggcgtctactttagaaagtggggtcccgtcaaggttcagcggcagtggatctgggacagaattcactctcaccatcagcagcctgcagcctgatgattttgcaacttattactgccaacattatcatcgttattctcgaacgttcggccaagggaccaaggtggaaatcaaa

SEQ ID NO: 282 - protein, 119 aa, ARTIFICIAL
  Antibody
EVQLLESGGGLVQPGGSLRLSCAASGFTFSAYKMTWVRQAPGKGLEWVSSIYPSGGWTWYADSVKGRFTISRDNSKNTLYLQMNSLRAEDTAVYYCARDNWQGGAFDIWGQGTMVTVSS

SEQ ID NO: 283 - DNA, 357 bp, ARTIFICIAL
  Antibody
gaagttcaattgttagagtctggtggcggtcttgttcagcctggtggttctttacgtctttcttgcgctgcttccggattcactttctctgcttacaagatgacttgggttcgccaagctcctggtaaaggtttggagtgggtttcttctatctatccttctggtggctggacttggtatgctgactccgttaaaggtcgcttcactatctctagagacaactctaagaatactctctacttgcagatgaacagcttaagggctgaggacacggccgtgtattactgtgcgagagataactggcagggcggtgcttttgacatctggggccaagggacaatggtcaccgtctcaagc

SEQ ID NO: 284 - protein, 108 aa, ARTIFICIAL
  Antibody
QDIQMTQSPGTLSLSPGERATLSCRASQSVNSNQLAWYQQKPGQAPRLLIYGASNRATGIPARFSGSGSGTDFTLTISSLEPEDFAVYYCQQRSNFWTFGQGTKVEIK

SEQ ID NO: 285 - DNA, 324 bp, ARTIFICIAL
  Antibody
caagacatccagatgacccagtctccaggcaccctgtctttgtctccaggggaaagagccaccctctcctgcagggccagtcagagtgttaacagcaaccagttagcctggtaccagcagaaacctggccaggctcccaggctcctcatctatggtgcatccaacagggccactggcatcccagccaggttcagtggcagtgggtctgggacagacttcactctcaccatcagcagcctagagcctgaagattttgcagtctattactgtcagcagcgtagcaacttttggacgttcggccaagggaccaaggtggaaatcaaa

SEQ ID NO: 286 - protein, 125 aa, ARTIFICIAL
  Antibody
EVQLLESGGGLVQPGGSLRLSCAASGFTFSRYLMMWVRQAPGKGLEWVSSIYPSGGWTYYADSVKGRFTISRDNSKNTLYLQMNSLRAEDTAMYYCARVAPYDSSGSVNYAFDPWGQGTLVTVSS

SEQ ID NO: 287 - DNA, 375 bp, ARTIFICIAL
  Antibody
gaagttcaattgttagagtctggtggcggtcttgttcagcctggtggttctttacgtctttcttgcgctgcttccggattcactttctctcgttaccttatgatgtgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacaccgccatgtattactgtgccagagtcgccccctatgatagtagtggttcggtaaattacgcgttcgacccctggggccagggcaccctggtcaccgtctcaagc

SEQ ID NO: 288 - protein, 108 aa, ARTIFICIAL
  Antibody
QDIQMTQSPSSLSASVGDRVTITCRASQNINIYLNWYQQKPGRAPSLLIYTQSNLRSGVPSRFSGSGYGTDFTLTISGLQPEDFATYYCQQSHSAPRTFGQGTRVEIK

SEQ ID NO: 289 - DNA, 324 bp, ARTIFICIAL
  Antibody
caagacatccagatgacccagtctccatcctccctgtctgcatctgtaggagacagagtcaccatcacttgccgggcaagtcagaacattaacatctatttgaattggtatcagcagaagccagggagagcccctagcctcctgatttatactcaatccaatttgcgaagtggggtcccatcaaggttcagtggcagtggatatggcacagatttcactctcaccatcagcggtctgcaacctgaagattttgcaacttactactgtcaacagagtcacagtgccccccggacgttcggccaggggaccagggtggaaatcaaa

SEQ ID NO: 290 - protein, 123 aa, ARTIFICIAL
  Antibody
EVQLLESGGGLVQPGGSLRLSCAASGFTFSHYKMVWVRQAPGKGLEWVSVIYPSGGWTRYADSVKGRFTISRDNSKNTLYLQMNSLRAEDTAVYYCAREMIDTISPGWHFDLWGRGTLVTVSS

SEQ ID NO: 291 - DNA, 369 bp, ARTIFICIAL
  Antibody
gaagttcaattgttagagtctggtggcggtcttgttcagcctggtggttctttacgtctttcttgcgctgcttccggattcactttctctcattacaagatggtttgggttcgccaagctcctggtaaaggtttggagtgggtttctgttatctatccttctggtggctggactcgttatgctgactccgttaaaggtcgcttcactatctctagagacaactctaagaatactctctacttgcagatgaacagcttaagggctgaggacacggccgtgtattactgtgcaagagaaatgattgacactatttcgcccggctggcacttcgatctctggggccgtggcaccctggtcaccgtctcaagc

SEQ ID NO: 292 - protein, 109 aa, ARTIFICIAL
  Antibody
QSELTQDPAVSVALGQTVRITCQGDSLRSYYASWYQQKPGQAPVLVMYGKNNRPSGIPDRFSGSSSGNTASLTITGAQAEDEADYYCQSRGSSSGNHYVFGTGTKVTVL

SEQ ID NO: 293 - DNA, 327 bp, ARTIFICIAL
  Antibody
cagagcgaattgactcaggaccctgctgtgtctgtggccttgggacagacagtcaggatcacatgccaaggagacagcctcagaagctattatgcaagctggtaccagcagaagccaggacaggcccctgtacttgtcatgtatggtaaaaacaaccggccctcagggatcccagaccgattctctggctccagttcaggaaacacagcttccttgaccatcactggggctcaggcggaagatgaggctgactattactgtcagtcccggggcagcagcagtggtaaccattatgtcttcggaactgggaccaaggtcaccgtccta

SEQ ID NO: 294 - protein, 127 aa, ARTIFICIAL
  Antibody
EVQLLESGGGLVQPGGSLRLSCAASGFTFSRYQMMWVRQAPGKGLEWVSSIYPSGGFTRYADSVKGRFTISRDNSKNILYLQMNSLRAEDTAVYYCAKSYYYGSGTYHYSYYGMDVWGQGTTVTVSS

SEQ ID NO: 295 - DNA, 381 bp, ARTIFICIAL
  Antibody
gaagttcaattgttagagtctggtggcggtcttgttcagcctggtggttctttacgtctttcttgcgctgcttccggattcactttctctcgttaccagatgatgtgggttcgccaagctcctggtaaaggtttggagtgggtttcttctatctatccttctggtggctttactcgttatgctgactccgttaaaggtcgcttcactatctctagagacaactctaagaatattctctacttgcagatgaacagcttaagggctgaggacacggccgtatattactgtgcgaaatcatattactatgggtcggggacctatcattactcttactacggtatggacgtctggggccaagggaccacggtcaccgtctcaagc

SEQ ID NO: 296 - protein, 109 aa, ARTIFICIAL
  Antibody
QDIQMTQSPGTLSLSPGERATLSCRASQSVSSTYLAWYQQKPGQAPRLLIYGASSRATGIPDRFTGSGSGTDFTLTISRLEPEDFAVYYCQHYGSSPLTFGGGTKVEIK

SEQ ID NO: 297 - DNA, 327 bp, ARTIFICIAL
  Antibody
caagacatccagatgacccagtctccaggcaccttgtctttgtctccaggggaaagagccaccctctcctgcagggccagtcagagtgttagtagcacctacttagcctggtaccagcagaaacctggccaggctcccaggctcctcatctatggtgcatccagcagggccactggcatcccagacaggttcactggcagtgggtctgggacagacttcactctcaccatcagcagactggagcctgaagattttgcagtgtattactgtcagcactatggtagctcaccgctcactttcggcggagggaccaaggtggagatcaaa

SEQ ID NO: 298 - protein, 124 aa, ARTIFICIAL
  Antibody
EVQLLESGGGLVQPGGSLRLSCAASGFTFSRYRMDWVRQAPGKGLEWVSGIYPSGGHTYYADSVKGRFTISRDNSKNTLYLQMNSLRAEDTATYYCARLYLWGSYPTQVAFDIWGQGTMVTVSS

SEQ ID NO: 299 - DNA, 372 bp, ARTIFICIAL
  Antibody
gaagttcaattgttagagtctggtggcggtcttgttcagcctggtggttctttacgtctttcttgcgctgcttccggattcactttctctcgttaccgtatggattgggttcgccaagctcctggtaaaggtttggagtgggtttctggtatctatccttctggtggccatacttattatgctgactccgttaaaggtcgcttcactatctctagagacaactctaagaatactctctacttgcagatgaacagcttaagggctgaggacacagccacgtattactgtgcgagactttacctttgggggagttatcccacccaggttgcttttgatatctggggccaagggacaatggtcaccgtctcaagc

SEQ ID NO: 300 - protein, 108 aa, ARTIFICIAL
  Antibody
QDIQMTQSPATLSVSPGERATLSCRASQSVSSNLAWYQQKPGQAPRLLIYGASTRATGIPARFSGSGSGTDFTLTISSLEPEDFAVYYCQQRSNWPLTFGGGTKVEIK

SEQ ID NO: 301 - DNA, 324 bp, ARTIFICIAL
  Antibody
caagacatccagatgacccagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagacttcactctcaccatcagcagcctagagcctgaagattttgcagtttattactgtcagcagcgtagcaactggccgctcactttcggcggagggaccaaggtggagatcaaa

SEQ ID NO: 302 - protein, 122 aa, ARTIFICIAL
  Antibody
EVQLLESGGGLVQPGGSLRLSCAASGFTFSMYPMLWVRQAPGKGLEWVSSIYPSGGMTYYADSVKGRFTISRDNSKNTLYLQMNSLRAEDTAVYYCARQGYYDSSGWTFDYWGQGTLVTVSS

SEQ ID NO: 303 - DNA, 366 bp, ARTIFICIAL
  Antibody
gaagttcaattgttagagtctggtggcggtcttgttcagcctggtggttctttacgtctttcttgcgctgcttccggattcactttctctatgtaccctatgctttgggttcgccaagctcctggtaaaggtttggagtgggtttcttctatctatccttctggtggcatgacttattatgctgactccgttaaaggtcgcttcactatctctagagacaactctaagaatactctctacttgcagatgaacagcttaagggctgaggacacggccgtgtattactgtgcgagacaaggttactatgatagtagtgggtggacctttgactactggggccagggaaccctggtcaccgtctcaagc

SEQ ID NO: 304 - protein, 108 aa, ARTIFICIAL
  Antibody
QDIQMTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 305 - DNA, 324 bp, ARTIFICIAL
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgctcactttcggcggagggaccaaggtggagatcaaa

SEQ ID NO: 306 - protein, 119 aa, ARTIFICIAL
  Antibody
EVQLLESGGGLVQPGGSLRLSCAASGFTFSAYVMNWVRQAPGKGLEWVSGIYSSGGYIYYADSVKGRFTISRDNSKNTLYLQMNSLRAEDTATYYCARRHFNGVGFDLWGQGTMVTVSS

SEQ ID NO: 307 - DNA, 357 bp, ARTIFICIAL
  Antibody
gaagttcaattgttagagtctggtggcggtcttgttcagcctggtggttctttacgtctttcttgcgctgcttccggattcactttctctgcttacgttatgaattgggttcgccaagctcctggtaaaggtttggagtgggtttctggtatctattcttctggtggctatatttattatgctgactccgttaaaggtcgcttcactatctctagagacaactctaagaatactctctacttgcagatgaacagcttaagggctgaggacacagccacatattactgtgcgagaagacatttcaacggggttggttttgatctctggggccaagggacaatggtcaccgtctcaagc

SEQ ID NO: 308 - protein, 105 aa, ARTIFICIAL
  Antibody
QDIQMTQSPGTLSLSPGERATLSCRASQSVSSSNLAWYQQKPGQAPRLLIYGASTRATGIPARFSGSGSGTEFTLTISSLQSEDFAVYYCQLYKTFGGGTKVEIK

SEQ ID NO: 309 - DNA, 315 bp, ARTIFICIAL
  Antibody
caagacatccagatgacccagtctccaggcaccctgtctttgtctccaggggaaagagccaccctctcctgcagggccagtcagagtgttagcagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagctgtataagactttcggcggagggaccaaggtggagatcaaa

SEQ ID NO: 310 - protein, 124 aa, ARTIFICIAL
  Antibody
EVQLLESGGGLVQPGGSLRLSCAASGFTFSNYKMNWVRQAPGKGLEWVSVIYPSGGGTYYADSVKGRFTISRDNSKNTLYLQMNSLRAEDTAVYYCARVGYSSGWFLFYGMDVWGQGTTVTVSS

SEQ ID NO: 311 - DNA, 372 bp, ARTIFICIAL
  Antibody
gaagttcaattgttagagtctggtggcggtcttgttcagcctggtggttctttacgtctttcttgcgctgcttccggattcactttctctaattacaagatgaattgggttcgccaagctcctggtaaaggtttggagtgggtttctgttatctatccttctggtggcggtacttattatgctgactccgttaaaggtcgcttcactatctctagagacaactctaagaatactctctacttgcagatgaacagcttaagggctgaggacacggctgtgtattactgtgcgagagtcgggtatagcagtggctggtttctcttttacggtatggacgtctggggccaagggaccacggtcaccgtctcaagc

SEQ ID NO: 312 - protein, 112 aa, ARTIFICIAL
  Antibody
QSALTQPRSVSGSPGQSVTISCTGSNTDVGRYNFVSWYQQKPGKAPKLIIYDVYKRPSGVPDRFSGSKSGNTASLTISGLQADDEADYYCCSYARASTFSYVFGIGTEVTVL

SEQ ID NO: 313 - DNA, 336 bp, ARTIFICIAL
  Antibody
cagagcgctttgactcagcctcgctcagtgtccgggtctcctggacagtcagtcaccatctcctgcactggatccaatactgatgttggtcgatacaattttgtttcctggtaccaacaaaagccaggcaaagcccccaaactcataatttatgatgtctataagcggccctcaggggtccctgatcgcttctctggctccaagtctggcaacacggcctccctgaccatctctgggctccaggctgacgatgaggctgattattactgctgctcatatgctcgcgcctccactttctcttatgtcttcggaattgggaccgaagtcaccgtcctt

SEQ ID NO: 314 - protein, 119 aa, ARTIFICIAL
  Antibody
EVQLLESGGGLVQPGGSLRLSCAASGFTFSSYIMVWVRQAPGKGLEWVSSIYPSGGHTPYADSVKGRFTISRDNSKNTLYLQMNSLRAEDTAVYYCARQTGGYAHFDYWGQGTLVTVSS

SEQ ID NO: 315 - DNA, 357 bp, ARTIFICIAL
  Antibody
gaagttcaattgttagagtctggtggcggtcttgttcagcctggtggttctttacgtctttcttgcgctgcttccggattcactttctcttcttacattatggtttgggttcgccaagctcctggtaaaggtttggagtgggtttcttctatctatccttctggtggccatactccttatgctgactccgttaaaggtcgcttcactatctctagagacaactctaagaatactctctacttgcagatgaacagcttaagggctgaggacacggccgtgtattactgtgcgagacagacgggtggctacgcccactttgattactggggccagggaaccctggtcaccgtctcaagc

SEQ ID NO: 316 - protein, 108 aa, ARTIFICIAL
  Antibody
QDIQMTQSPSSLSASVGDRVTMTCRASQGIGTYLAWYQQKPGKVPKLLIYAASTLQSGVPSRFSGSGSGTDFTLTISSLQPEDVATYYCQKYNSAPRPFGQGTQVEIK

SEQ ID NO: 317 - DNA, 324 bp, ARTIFICIAL
  Antibody
caagacatccagatgacccagtctccgtcctccctgtctgcatctgtaggagacagagtcaccatgacttgccgggcgagtcagggcattggcacttatttagcctggtatcagcagaaaccagggaaagttcctaagctcctgatctatgctgcgtccactttgcaatcaggggtcccatctcggttcagtggcagtggatctgggacggatttcactctcaccatcagcagcctgcagcctgaagatgttgcaacttattactgtcaaaagtataacagtgcccctcgtccgttcggccaagggacccaggtggaaatcaaa

SEQ ID NO: 318 - protein, 116 aa, ARTIFICIAL
  Antibody
EVQLLESGGGLVQPGGSLRLSCAASGFTFSSYVMHWVRQAPGKGLEWVSSIYPSGGWTLYADSVKGRFTISRDNSKNTLYLQMNSLRAEDTAVYYCARAVGPFDYWGQGTLVTVSS

SEQ ID NO: 319 - DNA, 348 bp, ARTIFICIAL
  Antibody
gaagttcaattgttagagtctggtggcggtcttgttcagcctggtggttctttacgtctttcttgcgctgcttccggattcactttctcttcttacgttatgcattgggttcgccaagctcctggtaaaggtttggagtgggtttcttctatctatccttctggtggctggactctttatgctgactccgttaaaggtcgcttcactatctctagagacaactctaagaatactctctacttgcagatgaacagcttaagggctgaggacacggccgtgtattactgtgcgagagcagtgggaccttttgactactggggccagggcaccctggtcaccgtctcaagc

SEQ ID NO: 320 - protein, 109 aa, ARTIFICIAL
  Antibody
QYELIQPPSVSGIPGQRVTISCSGNNSNFGSNTVTWYQQLPGTAPKLLIYSDSRRPSGVPDRFSGSRSDTSASLAISGLQSEDEAEYHCAAWDDSLNGVFGGGTKLTVL

SEQ ID NO: 321 - DNA, 327 bp, ARTIFICIAL
  Antibody
cagtacgaattgattcagccaccctcagtgtctgggatccccggacagagggtcaccatctcttgttctggaaacaactccaacttcggaagtaatactgtaacctggtaccagcagctcccaggaacggcccccaaactcctcatctatagtgatagtcggcggccctcaggggtccctgaccgattctctggctccaggtctgacacctcagcctccctggccatcagtgggctccagtctgaggatgaggctgagtatcactgtgcagcatgggatgacagcctaaatggggtgttcggcggagggaccaagctgaccgtccta

SEQ ID NO: 322 - protein, 126 aa, ARTIFICIAL
  Antibody
EVQLLESGGGLVQPGGSLRLSCAASGFTFSRYKMEWVRQAPGKGLEWVSVIYPSGGHTNYADSVKGRFTISRDNSKNTLYLQMNSLRAEDTAVYYCARGGYYDILTGYYKYYFDYWGQGTLVTVSS

SEQ ID NO: 323 - DNA, 378 bp, ARTIFICIAL
  Antibody
gaagttcaattgttagagtctggtggcggtcttgttcagcctggtggttctttacgtctttcttgcgctgcttccggattcactttctctcgttacaagatggagtgggttcgccaagctcctggtaaaggtttggagtgggtttctgttatctatccttctggtggccatactaattatgctgactccgttaaaggtcgcttcactatctctagagacaactctaagaatactctctacttgcagatgaacagcttaagggctgaggacacggccgtgtattactgtgcgagaggaggctattacgatattttgactggttattataagtactactttgactactggggccagggaaccctggtcaccgtctcaagc

SEQ ID NO: 324 - protein, 109 aa, ARTIFICIAL
  Antibody
QDIQMTQSPSPLSASVGDSVTITCRASQRIGSYLNWYQQNPGKAPKLLIYGASNLESGVPSRFSGRGSGTEFTLTITSLQPEDFATYFCQQTSSVSPLTFGQGTRLDIK

SEQ ID NO: 325 - DNA, 327 bp, ARTIFICIAL
  Antibody
caagacatccagatgacccagtctccatcccccctgtctgcatctgtaggagacagtgtcaccatcacttgtcgggcaagtcagaggattggcagctacttgaattggtatcagcagaatccaggcaaagccccaaaactcctgatctacggtgcatccaatttggaaagtggggtcccatcaaggttcagtggccgtggatctgggacagagttcacactcaccatcaccagtctgcaacctgaagattttgcaacttatttctgtcaacagacctccagtgtctccccgctcaccttcggccaagggacacgactggacattaaa

SEQ ID NO: 326 - protein, 127 aa, ARTIFICIAL
  Antibody
EVQLLESGGGLVQPGGSLRLSCAASGFTFSSYKMSWVRQAPGKGLEWVSVIYPSGGWTWYADSVKGRFTISRDNSKNTLYLQMNSLRAEDTAVYYCARMMYYYDSSGYLRADAFDIWGQGTMVTVSS

SEQ ID NO: 327 - DNA, 381 bp, ARTIFICIAL
  Antibody
gaagttcaattgttagagtctggtggcggtcttgttcagcctggtggttctttacgtctttcttgcgctgcttccggattcactttctcttcttacaagatgtcttgggttcgccaagctcctggtaaaggtttggagtgggtttctgttatctatccttctggtggctggacttggtatgctgactccgttaaaggtcgcttcactatctctagagacaactctaagaatactctctacttgcagatgaacagcttaagggctgaggacacggccgtgtattactgtgcgagaatgatgtattactatgatagtagtggttacctaagggctgatgcttttgatatctggggccaagggacaatggtcaccgtctcaagc

SEQ ID NO: 328 - protein, 109 aa, ARTIFICIAL
  Antibody
QDIQMTQSPGTLSTSIGDRVTITCRASQSINEWLAWYQQKPGKAPKLLIYAASSLQSGVPSRFSGSGSGTDFTLTISRLEPEDFAVYYCQQYGSSPALTFGGGTKVEIK

SEQ ID NO: 329 - DNA, 327 bp, ARTIFICIAL
  Antibody
caagacatccagatgacccagtctccaggcaccctctctacatctataggagacagagtcaccatcacttgccgggccagtcagagtattaatgagtggttggcctggtatcagcagaaaccagggaaagcccctaagctcctgatctatgctgcatccagtttgcaaagtggggtcccatcaaggttcagtggcagtggatctgggacagacttcactctcaccatcagcagactggagcctgaagattttgcagtgtattactgtcagcagtatggtagctcacccgcgctcactttcggcggagggaccaaggtggagatcaaa

SEQ ID NO: 330 - protein, 119 aa, ARTIFICIAL
  Antibody
EVQLLESGGGLVQPGGSLRLSCAASGFTFSAYKMMWVRQAPGKGLEWVSSIYPSGGWTYYADSVKGRFTISRDNSKNTLYLQMNSLRAEDTALYYCARSMGYGDAFDIWGQGTMVTVSS

SEQ ID NO: 331 - DNA, 357 bp, ARTIFICIAL
  Antibody
gaagttcaattgttagagtctggtggcggtcttgttcagcctggtggttctttacgtctttcttgcgctgcttccggattcactttctctgcttacaagatgatgtgggttcgccaagctcctggtaaaggtttggagtgggtttcttctatctatccttctggtggctggacttattatgctgactccgttaaaggtcgcttcactatctctagagacaactctaagaatactctctacttgcagatgaacagtttaagggctgaggacaccgccttgtattactgtgcgagatcaatgggctatggtgatgcttttgatatctggggccaagggacaatggtcaccgtctcaagc

SEQ ID NO: 332 - protein, 109 aa, ARTIFICIAL
  Antibody
QDIQMTQSPSSLSASVGDRVTITCRASQTIRSYLNWYQQKPGKAPKLLIYAASNLQSGVPSRFSGSGSGTDFTLTISSLQPEDFATYYCQQSYSMSSWTFGQGTNLEIK

SEQ ID NO: 333 - DNA, 327 bp, ARTIFICIAL
  Antibody
caagacatccagatgacccagtctccatcctccctgtctgcatctgtaggagacagagtcacaatcacttgccgggcaagtcagaccattagaagctatttaaattggtatcagcagaaaccagggaaagcccctaagctcctgatctatgctgcatccaatttgcaaagtggggtcccatcaaggttcagtggcagtgggtctgggacagacttcactctcaccatcagcagtctgcaacctgaagattttgcaacttactactgtcaacagagttacagtatgtcgtcgtggacttttggccaggggaccaacctggagatcaaa

SEQ ID NO: 334 - protein, 118 aa, ARTIFICIAL
  Antibody
EVQLLESGGGLVQPGGSLRLSCAASGFTFSVYPMAWVRQAPGKGLEWVSWISPGGKTYYADSVKGRFTISRDNSKNTLYLQMNSLRAEDTATYYCARGSRHYDKFDYWGQGTLVTVSS

SEQ ID NO: 335 - DNA, 354 bp, ARTIFICIAL
  Antibody
gaagttcaattgttagagtctggtggcggtcttgttcagcctggtggttctttacgtctttcttgcgctgcttccggattcactttctctgtttaccctatggcttgggttcgccaagctcctggtaaaggtttggagtgggtttcttggatctctcctggtggcaagacttattatgctgactccgttaaaggtcgcttcactatctctagagacaactctaagaatactctctacttgcagatgaacagcttaagggctgaggacacagccacgtattactgtgcgagagggagccgccactatgataagtttgactactggggccagggaaccctggtcaccgtctcaagc

SEQ ID NO: 336 - protein, 110 aa, ARTIFICIAL
  Antibody
QSVLTQPASVSGSPGQSITISCTGTSSDVGGYNYVSWYQQHPGKAPKVMIYDVSNRPSGVSNRFSGSKSGNTASLTISGLLAEDEADYYCSSYTSTATYVLGTGTRVTVV

SEQ ID NO: 337 - DNA, 330 bp, ARTIFICIAL
  Antibody
cagagcgtcttgactcagcctgcctccgtgtctgggtctcctggacagtcgatcaccatctcctgcactggaaccagcagtgacgttggtggttacaactatgtctcctggtaccaacaacacccaggcaaagcccccaaagtcatgatttatgatgtcagtaatcggccctcaggggtttctaatcgcttctctggctccaagtctggcaacacggcctccctgaccatctcggggctcctggctgaggacgaagctgattattactgcagctcatatacaagtacagccacctatgtcctcggaactgggaccagggtcaccgtcgta

SEQ ID NO: 338 - protein, 118 aa, ARTIFICIAL
  Antibody
EVQLLESGGGLVQPGGSLRLSCAASGFTFSHYKMAWVRQAPGKGLEWVSVIYPSGGATYYADSVKGRFTISRDNSKNTLYLQMNSLRAEDTAVYYCARALPGGYFDYWGQGTLVTVSS

SEQ ID NO: 339 - DNA, 354 bp, ARTIFICIAL
  Antibody
gaagttcaattgttagagtctggtggcggtcttgttcagcctggtggttctttacgtctttcttgcgctgcttccggattcactttctctcattacaagatggcttgggttcgccaagctcctggtaaaggtttggagtgggtttctgttatctatccttctggtggcgctacttattatgctgactccgttaaaggtcgcttcactatctctagagacaactctaagaatactctctacttgcagatgaacagcttaagggctgaggacacggccgtgtattactgtgcaagggccttaccggggggctactttgactactggggccagggcaccctggtcaccgtctcaagc

SEQ ID NO: 340 - protein, 109 aa, ARTIFICIAL
  Antibody
QDIQMTQSPGTLSLSPGERATLACRASQSVSSSYLAWYQQKPGQAPRLLIYGASNRATGIPDRFSGSGSDTDFTLKISRVEAEDVGTYYCMQATFWPYAFGQGTKLEIK

SEQ ID NO: 341 - DNA, 327 bp, ARTIFICIAL
  Antibody
caagacatccagatgacccagtctccaggcaccctgtctttgtctccaggggaaagagccaccctcgcctgcagggccagtcagagtgttagcagcagctacttagcctggtaccagcagaaacctggccaggctcccaggctcctcatctatggtgcatccaacagggccactggcatcccagacagattcagcggcagtgggtcagacactgatttcacactgaaaatcagcagggtggaggctgaggatgttgggacttattactgcatgcaagctacattctggccgtacgcttttggccaggggaccaagctggagatcaaa

SEQ ID NO: 342 - protein, 126 aa, ARTIFICIAL
  Antibody
EVQLLESGGGLVQPGGSLRLSCAASGFTFSWYRMVWVRQAPGKGLEWVSGIYPSGGFTSYADSVKGRFTISRDNSKNTLYLQMNSLRAEDTAVYYCARVYYYDSSGYYFRGGFDPWGQGTLVTVSS

SEQ ID NO: 343 - DNA, 378 bp, ARTIFICIAL
  Antibody
gaagttcaattgttagagtctggtggcggtcttgttcagcctggtggttctttacgtctttcttgcgctgcttccggattcactttctcttggtaccgtatggtttgggttcgccaagctcctggtaaaggtttggagtgggtttctggtatctatccttctggtggctttacttcttatgctgactccgttaaaggtcgcttcactatctctagagacaactctaagaatactctctacttgcagatgaacagcttaagggctgaggacacggccgtgtattactgtgcgagagtgtattactatgatagtagtggttattatttccgtggggggttcgacccctggggccagggcaccctggtcaccgtctcaagc

SEQ ID NO: 344 - protein, 109 aa, ARTIFICIAL
  Antibody
QSVLTQPPSVSGIPGQRVTISCSGNNSNFGSNTVTWYQQLPGTAPKLLIYSDSRRPSGVPDRFSGSRSDTSASLAISGLQSEDEAEYHCAAWDDSLNGVFGGGTKLTVL

SEQ ID NO: 345 - DNA, 327 bp, ARTIFICIAL
  Antibody
cagagcgtcttgactcagccaccctcagtgtctgggatccccggacagagggtcaccatctcttgttctggaaacaactccaacttcggaagtaatactgtaacctggtaccagcagctcccaggaacggcccccaaactcctcatctatagtgatagtcggcggccctcaggggtccctgaccgattctctggctccaggtctgacacctcagcctccctggccatcagtgggctccagtctgaggatgaggctgagtatcactgtgcagcatgggatgacagcctaaatggggtgttcggcggagggaccaagctgaccgtccta

SEQ ID NO: 346 - protein, 121 aa, ARTIFICIAL
  Antibody
EVQLLESGGGLVQPGGSLRLSCAASGFTFSQYLMQWVRQAPGKGLEWVSSIYPSGGATYYADSVKGRFTISRDNSKNTLYLQMNSLRAEDTAVYYCATRKDGYSRSAFDIWGQGTMVTVSS

SEQ ID NO: 347 - DNA, 363 bp, ARTIFICIAL
  Antibody
gaagttcaattgttagagtctggtggcggtcttgttcagcctggtggttctttacgtctttcttgcgctgcttccggattcactttctctcagtaccttatgcagtgggttcgccaagctcctggtaaaggtttggagtgggtttcttctatctatccttctggtggcgctacttattatgctgactccgttaaaggtcgcttcactatctctagagacaactctaagaatactctctacttgcagatgaacagcttaagggctgaggacacggccgtgtattactgtgcaacaaggaaggatggctacagtcgaagtgcttttgatatctggggccaagggacaatggtcaccgtctcaagc

SEQ ID NO: 348 - protein, 109 aa, ARTIFICIAL
  Antibody
QDIQMTQSPGTLSLSPGERATLSCRASQSVSSSYLAWYQQKPGQAPRLLIYGASSRATGIPDRFSGSGSGTDFTLTISRLEPEDFAVYYCQQRGNWPRTFGQGTKVEIK

SEQ ID NO: 349 - DNA, 327 bp, ARTIFICIAL
  Antibody
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagcgtggcaactggccccggacgttcggccaagggaccaaggtggaaatcaaa

SEQ ID NO: 350 - protein, 118 aa, ARTIFICIAL
  Antibody
EVQLLESGGGLVQPGGSLRLSCAASGFTFSHYVMWWVRQAPGKGLEWVSGIYPSGWTVYADSVKGRFTISRDNSKNTLYLQMNSLRAEDTAVYYCAKDLGGTRAFDYWGQGTLVTVSS

SEQ ID NO: 351 - DNA, 354 bp, ARTIFICIAL
  Antibody
gaagttcaattgttagagtctggtggcggtcttgttcagcctggtggttctttacgtctttcttgcgctgcttccggattcactttctctcattacgttatgtggtgggttcgccaagctcctggtaaaggtttggagtgggtttctggtatctatccttctggttggactgtttatgctgactccgttaaaggtcgcttcactatctctagagacaactctaagaatactctctacttgcagatgaacagcttaagggctgaggacacggccgtgtattactgtgcgaaagatctgggggggacccgtgcctttgactactggggccagggaaccctggtcaccgtctcaagc

SEQ ID NO: 352 - protein, 110 aa, ARTIFICIAL
  Antibody
QSELTQPASVSGSPGQSITISCTGTSSDDVGGYNYVSWYQQHPGKAPKLLIYDVSDRPSGVSNRFSGSKSGNTASLTISGLLAEDEADYYCGSYRVTSVSRSYVFGTETK

SEQ ID NO: 353 - DNA, 330 bp, ARTIFICIAL
  Antibody
cagagcgaattgactcagcctgcctccgtgtctgggtctcctggacagtcgatcaccatctcctgcactggaaccagcagtgacgacgttggtggttataactatgtctcctggtaccaacaacacccaggcaaagcccccaaactcctgatttatgatgtcagtgatcggccctcaggggtttctaatcgcttctctggctccaagtctggcaacacggcctccctgaccatctctgggctcctggctgaggacgaggctgattattattgcggctcatatcgcgtcaccagcgtcagcagatcctatgtcttcggaactgagaccaag

SEQ ID NO: 354 - protein, 117 aa, ARTIFICIAL
  Antibody
EVQLLESGGGLVQPGGSLRLSCAASGFTFSNYPMTWVRQAPGKGLEWVSRIYPSGGYTYYADSVKGRFTISRDNSKNTLYLQMNSLRAEDTAVYYCARGRIAALDYWGQGTLVTVSS

SEQ ID NO: 355 - DNA, 351 bp, ARTIFICIAL
  Antibody
gaagttcaattgttagagtctggtggcggtcttgttcagcctggtggttctttacgtctttcttgcgctgcttccggattcactttctctaattaccctatgacttgggttcgccaagctcctggtaaaggtttggagtgggtttctcgtatctatccttctggtggctatacttattatgctgactccgttaaaggtcgcttcactatctctagagacaactctaagaatactctctacttgcagatgaacagcttaagggctgaggacacggccgtgtattactgtgcgaggggtcgtatagcagctcttgactactggggccagggcaccctggtcaccgtctcaagc

SEQ ID NO: 356 - protein, 107 aa, ARTIFICIAL
  Antibody
QSALTQGPTVSVALGQTVRITCQGDTLRYFSASWYQQKPGQAPVLVIFGANNRPSGIPDRFSGSRSGVTASLTITGAQAEDEAEYYCNSRDGSGNWLFGGGTKLSVL

SEQ ID NO: 357 - DNA, 321 bp, ARTIFICIAL
  Antibody
cagagcgctttgactcagggccctactgtgtctgtggccttgggacagacagtcaggatcacatgtcaaggagacaccctcagatacttttctgcaagttggtaccagcagaagccgggacaggcccctgtccttgtcatctttggggcaaacaatcggccctcagggatcccagaccggttctctggctccaggtcaggagtcaccgcttccttgaccatcactggggctcaggcggaagatgaggctgagtattactgtaactcccgggacggcagtggtaattggctgttcggcggagggaccaagctgtccgtcctc

SEQ ID NO: 358 - protein, 124 aa, ARTIFICIAL
  Antibody
EVQLLESGGGLVQPGGSLRLSCAASGFTFSRYVMHWVRQAPGKGLEWVSVIYPSGGATLYADSVKGRFTISRDNSKNTLYLQMNSLRAEDTAVYYCARGQYSSGWYTEGWFDPWGQGTLVTVSS

SEQ ID NO: 359 - DNA, 372 bp, ARTIFICIAL
  Antibody
gaagttcaattgttagagtctggtggcggtcttgttcagcctggtggttctttacgtctttcttgcgctgcttccggattcactttctctcgttacgttatgcattgggttcgccaagctcctggtaaaggtttggagtgggtttctgttatctatccttctggtggcgctactctttatgctgactccgttaaaggtcgcttcactatctctagagacaactctaagaatactctctacttgcagatgaacagcttaagggctgaggacacggccgtgtattactgtgcgagaggccagtatagcagtggctggtacacggagggctggttcgacccctggggccagggcaccctggtcaccgtctcaagc

SEQ ID NO: 360 - protein, 110 aa, ARTIFICIAL
  Antibody
QYELTQPPSASGTPGQRVTISCSGSSSNIGSNNVNWYQQLPGTAPKLLIYSNDQRPSGVPDRFSGSKSATSASLAISGLQSEDEADYHCAAWDDSLNGPVFGGGTKLTVL

SEQ ID NO: 361 - DNA, 330 bp, ARTIFICIAL
  Antibody
cagtacgaattgactcagccaccctcagcgtctgggacccccgggcagagggtcaccatctcttgttctggaagcagctccaacatcggaagtaataatgtcaactggtaccagcaactcccaggaacggcccccaaactcctcatctacagtaatgatcagcggccctcaggggtccctgaccgattctctggctccaagtctgccacctcagcctccctggccatcagtgggctccagtctgaggatgaggctgattatcactgtgcagcatgggatgacagcctgaatggtccggtgttcggcggagggaccaagctgaccgtccta

SEQ ID NO: 362 - protein, 119 aa, ARTIFICIAL
  Antibody
EVQLLESGGGLVQPGGSLRLSCAASGFTFSRYKMQWVRQAPGKGLEWVSSIYPSGGITYYADSVKGRFTISRDNSKNTLYLQMNSLRAEDTAVYYCARGRGTTRAFDYWGQGTLVTVSS

SEQ ID NO: 363 - DNA, 357 bp, ARTIFICIAL
  Antibody
gaagttcaattgttagagtctggtggcggtcttgttcagcctggtggttctttacgtctttcttgcgctgcttccggattcactttctctcgttacaagatgcagtgggttcgccaagctcctggtaaaggtttggagtgggtttcttctatctatccttctggtggcattacttattatgctgactccgttaaaggtcgcttcactatctctagagacaactctaagaatactctctacttgcagatgaacagcttaagggctgaggacacggccgtgtattactgtgcgagaggacgaggaacgacgcgggcttttgactactggggccagggaaccctggtcaccgtctcaagc

SEQ ID NO: 364 - protein, 108 aa, ARTIFICIAL
  Antibody
QYELTQPPSVSVAPGQTAKILCGGNDIGRKFVHWYQQKPGQAPVLVVFDDSDRPSGIPERFSGSNSGSTATLTISGVEAGDEADYFCQVWDLSSDHWVFGGGTKLTVL

SEQ ID NO: 365 - DNA, 324 bp, ARTIFICIAL
  Antibody
cagtacgaattgactcagccaccctcggtgtcagtggccccaggacagacggccaagattctctgtgggggaaacgacattggaagaaagtttgttcactggtaccagcagaagccaggccaggcccctgtgctggtcgtctttgatgatagcgaccggccctcagggatccctgagcgattctctggctccaattctgggagcacggccaccctgaccatcagcggggtcgaagccggggatgaggccgactatttctgtcaggtgtgggatcttagtagtgatcattgggtgttcggcggagggaccaagctgaccgtccta

SEQ ID NO: 366 - protein, 125 aa, ARTIFICIAL
  Antibody
EVQLLESGGGLVQPGGSLRLSCAASGFTFSDYAMHWVRQAPGKGLEWVSRIGSSGGHTSYADSVKGRFTISRDNSKNTLYLQMNSLRAEDTAMYYCATDYYYDSSGYYYPAFDIWGQGTMVTVSS

SEQ ID NO: 367 - DNA, 375 bp, ARTIFICIAL
  Antibody
gaagttcaattgttagagtctggtggcggtcttgttcagcctggtggttctttacgtctttcttgcgctgcttccggattcactttctctgattacgctatgcattgggttcgccaagctcctggtaaaggtttggagtgggtttctcgtatcggttcttctggtggccatacttcttatgctgactccgttaaaggtcgcttcactatctctagagacaactctaagaatactctctacttgcagatgaacagcttaagggctgaggacaccgccatgtattactgtgcgactgactattactatgatagtagtggttattactaccctgcttttgatatctggggccaagggacaatggtcaccgtctcaagc

SEQ ID NO: 368 - protein, 108 aa, ARTIFICIAL
  Antibody
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPLFGGGTKVEIK

SEQ ID NO: 369 - DNA, 324 bp, ARTIFICIAL
  Antibody
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctctgttcggcggagggaccaaggtggagatcaaa

SEQ ID NO: 370 - protein, 119 aa, ARTIFICIAL
  Antibody
EVQLLESGGGLVQPGGSLRLSCAASGFTFSRYAMMWVRQAPGKGLEWVSSIYPSGGSTYYADSVKGRFTISRDNSKNTLYLQMNSLRAEDTAVYYCARVQGGAGAFDIWGQGTMVTVSS

SEQ ID NO: 371 - DNA, 357 bp, ARTIFICIAL
  Antibody
gaagttcaattgttagagtctggtggcggtcttgttcagcctggtggttctttacgtctttcttgcgctgcttccggattcactttctctcgttacgctatgatgtgggttcgccaagctcctggtaaaggtttggagtgggtttcttctatctatccttctggtggctctacttattatgctgactccgttaaaggtcgcttcactatctctagagacaactctaagaatactctctacttgcagatgaacagcttaagggctgaggacacggccgtgtattactgtgcgagagtacaggggggggcgggtgcttttgatatctggggccaagggacaatggtcaccgtctcaagc

SEQ ID NO: 372 - protein, 109 aa, ARTIFICIAL
  Antibody
QDIQMTQSPSSLSASVGDRVTITCRASQSINTYLNWYQHKPGKAPELLISAASSLQSGVPSRFSGSGSGTDFTLTISSLRPEDFATYYCQQSHSISTFTFGPGTKVDVK

SEQ ID NO: 373 - DNA, 327 bp, ARTIFICIAL
  Antibody
caagacatccagatgacccagtctccatcttccctgtctgcatctgtcggagacagagtcaccatcacttgccgggcaagtcagagcattaacacctatttaaattggtatcagcacaaaccagggaaggcccctgagctcctgatctctgctgcatctagcttgcaaagtggggtcccatcaaggttcagtggcagtggatctgggacagatttcactctcaccatcagcagtctgcgacctgaagattttgcgacttactactgtcaacagagtcacagtatatccacattcactttcggccctgggaccaaagtggatgtcaag

SEQ ID NO: 374 - protein, 126 aa, ARTIFICIAL
  Antibody
EVQLLESGGGLVQPGGSLRLSCAASGFTFSRYKMHWVRQAPGKGFEWVSSIVPSGGWTYYADSVKGRFTISRDNSKNTLYLQMNSLRAEDTAVYYCARQMYYYDSSGYYVGRFDIWGQGTTVTVSS

SEQ ID NO: 375 - DNA, 378 bp, ARTIFICIAL
  Antibody
gaagttcaattgttagagtctggtggcggtcttgttcagcctggtggttctttacgtctttcttgcgctgcttccggattcactttctctcgttacaagatgcattgggttcgccaagctcctggtaaaggttttgagtgggtttcttctatcgttccttctggtggctggacttattatgctgactccgttaaaggtcgcttcactatctctagagacaactctaagaatactctctacttgcagatgaacagcttaagggctgaggacacggccgtgtattactgtgcgagacaaatgtattactatgatagtagtggttattatgtcgggcgttttgatatctggggccaagggaccacggtcaccgtctcaagc

SEQ ID NO: 376 - protein, 110 aa, ARTIFICIAL
  Antibody
QDIQMTQSPATLSLSPGERATLSCRASQSVSSYLAWYQQKPGQAPRLLIYDASNRATGIPARFSGSGSGTDFTLTISSLEPEDFAVYYCQQRSNWPPRITFGGGTKVEIK

SEQ ID NO: 377 - DNA, 330 bp, ARTIFICIAL
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccccggatcactttcggcggagggaccaaggtggagatcaaa

SEQ ID NO: 378 - protein, 123 aa, ARTIFICIAL; identical to SEQ ID NO: 238
  Antibody

SEQ ID NO: 379 - DNA, 369 bp, ARTIFICIAL; identical to SEQ ID NO: 239
  Antibody

SEQ ID NO: 380 - protein, 110 aa, ARTIFICIAL
  Antibody
QDIQMTQSPATLSLSPGERATLSCRASQSVSSSYLAWYQQKPGQAPRLLIYGASSRATGIPDRFSGSGSGTDFTLTISRLEPEDFAVYYCQQYGSSPQLTFGGGTKVEIK

SEQ ID NO: 381 - DNA, 330 bp, ARTIFICIAL
  Antibody
caagacatccagatgacccagtctccagccaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccccagctcactttcggcggagggaccaaggtggagatcaaa

SEQ ID NO: 382 - protein, 118 aa, ARTIFICIAL
  Antibody
EVQLLESGGGLVQPGGSLRLSCAASGFTFSNYKMWWVRQAPGKGLEWVSSIYPSGGWTQYADSVKGRFTISRDNSKNTLYLQMNSLRAEDTAVYYCAKDVGGGGFDYWGQGTLVTVSS

SEQ ID NO: 383 - DNA, 354 bp, ARTIFICIAL
  Antibody
gaagttcaattgttagagtctggtggcggtcttgttcagcctggtggttctttacgtctttcttgcgctgcttccggattcactttctctaattacaagatgtggtgggttcgccaagctcctggtaaaggtttggagtgggtttcttctatctatccttctggtggctggactcagtatgctgactccgttaaaggtcgcttcactatctctagagacaactctaagaatactctctacttgcagatgaacagcttaagggctgaggacactgccgtgtattactgtgcgaaagatgttggggggggtggctttgactactggggccagggaaccctggtcaccgtctcaagc

SEQ ID NO: 384 - protein, 104 aa, ARTIFICIAL
  Antibody
QDIQMTQSPATLSVSPGERATLSCRASQSVSSNLAWYQQKPGQAPRLLIYGASTRATGIPARFSGSGSGTEFTLTISSLQSEDFAVYYCLTRVTFGGGTKVELK

SEQ ID NO: 385 - DNA, 312 bp, ARTIFICIAL
  Antibody
caagacatccagatgacccagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagaattcactctcaccatcagcagcctgcagtctgaagattttgcagtttattactgtctaacacgagtcactttcggcggagggaccaaggttgagctcaag

SEQ ID NO: 386 - protein, 130 aa, ARTIFICIAL
  Antibody
EVQLLESGGGLVQPGGSLRLSCAASGFTFSHYKMGWVRQAPGKGLEWVSSIYPSGGWTTYADSVKGRFTISRDNSKNTLYLQMNSLRAEDTAVYYCARDSPLVVPAAIKSGAYYYGMDVWGQGTTVTVSS

SEQ ID NO: 387 - DNA, 390 bp, ARTIFICIAL
  Antibody
gaagttcaattgttagagtctggtggcggtcttgttcagcctggtggttctttacgtctttcttgcgctgcttccggattcactttctctcattacaagatgggttgggttcgccaagctcctggtaaaggtttggagtgggtttcttctatctatccttctggtggctggactacttatgctgactccgttaaaggtcgcttcactatctctagagacaactctaagaatactctctacttgcagatgaacagcttaagggctgaggacacggccgtgtattactgtgcgagagattcccccctagtagtaccagctgctattaagagcggggcctactactacggtatggacgtctggggccaagggaccacggtcaccgtctcaagc

SEQ ID NO: 388 - protein, 110 aa, ARTIFICIAL
  Antibody
QSVLTQPPSASGTPGQRVSISCSGSSYNIGVYDVYWYQQLPGTAPKLLIYTNNQRPSGVPDRFSGSKSGTSASLSISGLRSEDEADYYCAAWDDSLAGWVFGGGTKVTVL

SEQ ID NO: 389 - DNA, 330 bp, ARTIFICIAL
  Antibody
cagagcgtcttgactcagccaccctcagcgtctgggacccccgggcagagggtcagtatctcttgttctggaagcagctacaacatcggagtttatgatgtatactggtaccagcagctcccaggaacggcccccaaactcctcatctataccaataatcagcggccctcaggggtccctgaccgattctctggctccaagtctggcacctcagcctccctgtccatcagtgggctccggtccgaggatgaggctgattattactgtgcagcctgggatgacagcctggctggttgggtgttcggcggagggaccaaggtgaccgtccta

SEQ ID NO: 390 - protein, 117 aa, ARTIFICIAL
  Antibody
EVQLLESGGGLVQPGGSLRLSCAASGFTFSRYVMLWVRQAPGKGLEWVSVIYPSGGYTYYADSVKGRFTISRDNSKNTLYLQMNSLRAEDTAVYYCARGVLRAFDIWGQGTMVTVSS

SEQ ID NO: 391 - DNA, 351 bp, ARTIFICIAL
  Antibody
gaagttcaattgttagagtctggtggcggtcttgttcagcctggtggttctttacgtctttcttgcgctgcttccggattcactttctctcgttacgttatgctttgggttcgccaagctcctggtaaaggtttggagtgggtttctgttatctatccttctggtggctatacttattatgctgactccgttaaaggtcgcttcactatctctagagacaactctaagaatactctctacttgcagatgaacagcttaagggctgaggacacggccgtgtattactgtgcgagaggggtactaagagcttttgatatctggggccaagggacaatggtcaccgtctcaagc

SEQ ID NO: 392 - protein, 108 aa, ARTIFICIAL
  Antibody
QDIQMTQSPATLSLSPGERATLSCRASQSVSSYLAWYQQKPGQAPRLLIYDTSNRATGIPARFSGSGSGTDFTLTISSLEPEDFAVYYCQQRSNWPITFGQGTRLEIK

SEQ ID NO: 393 - DNA, 324 bp, ARTIFICIAL
  Antibody
caagacatccagatgacccagtctccagccaccctgtctttgtctccgggggaaagagccaccctctcctgcagggccagtcagagtgttagcagctacttagcctggtaccaacagaaacctggccaggctcccaggctcctcatctatgatacatccaacagggccactggcatcccagccaggttcagtggcagtgggtctgggacagacttcactctcaccatcagcagtctagagcctgaagattttgcagtttattactgtcagcagcgtagcaactggccgatcaccttcggccaagggacacgactggagattaaa

SEQ ID NO: 394 - protein, 119 aa, ARTIFICIAL
  Antibody
EVQLLESGGGLVQPGGSLRLSCAASGFTFSGYGMYWVRQAPGKGLEWVSVISPSGGYTHYADSVKGRFTISRDNSKNTLYLQMNSLRAEDTAVYYCARAYSSGWYLDYWGQGTLVTVSS

SEQ ID NO: 395 - DNA, 357 bp, ARTIFICIAL
  Antibody
gaagttcaattgttagagtctggtggcggtcttgttcagcctggtggttctttacgtctttcttgcgctgcttccggattcactttctctggttacggtatgtattgggttcgccaagctcctggtaaaggtttggagtgggtttctgttatctctccttctggtggctatactcattatgctgactccgttaaaggtcgcttcactatctctagagacaactctaagaatactctctacttgcagatgaacagcttaagggctgaggacacggccgtgtattactgtgcgagagcgtatagcagtggctggtaccttgactactggggccagggaaccctggtcaccgtctcaagc

SEQ ID NO: 396 - protein, 106 aa, ARTIFICIAL
  Antibody
QSVLTQPPSLSVSPGQTARIACSGDNLGSRYISWYQQKSGQSPVVVLYQDYRRPSGIPERISGSNSGNTATLTISGTQAVDEADYYCQAWDRSTAVFGGGTRLTVL

SEQ ID NO: 397 - DNA, 318 bp, ARTIFICIAL
  Antibody
cagagcgtcttgactcagccaccctcactgtccgtgtccccagggcagacagcccgcatcgcctgctctggagataatttggggagtagatatatttcctggtatcagcagaagtcaggccagtctcctgtggtggtcctctatcaagactacagacggccctcagggatccctgagcgaatctctggctccaactctgggaacacagccactctgaccatcagcgggactcaggctgtggatgaggcggactattattgtcaggcgtgggacagaagcactgcggtgttcggcggagggaccaggctgaccgtccta

SEQ ID NO: 398 - protein, 123 aa, ARTIFICIAL; identical to SEQ ID NO: 238
  Antibody

SEQ ID NO: 399 - DNA, 369 bp, ARTIFICIAL; identical to SEQ ID NO: 239
  Antibody

SEQ ID NO: 400 - protein, 109 aa, ARTIFICIAL
  Antibody
QDIQMTQSPDTLSLSPGERATLSCRASHSVTNNRLAWYQQKPGQSPRLLIYGASNRAAGIPARFSGSGSGTDFTLTISSLEPEDFAVYYCQQRSHWLYTFGQGTKLEIK

SEQ ID NO: 401 - DNA, 327 bp, ARTIFICIAL
  Antibody
caagacatccagatgacccagtctccagacaccctgtctttgtctccaggagaaagagccaccctctcatgcagggccagtcacagtgttactaacaaccgcttagcctggtaccagcagaaacctggccagtctcccaggctcctcatctatggtgcatccaacagggccgctggcatccctgccaggttcagtggcagtggctctgggacagacttcactctcaccatcagcagcctagagcctgaagattttgcagtttattactgtcaacagcgtagccactggctttacacttttggccaggggaccaagctggagatcaaa

SEQ ID NO: 402 - protein, 119 aa, ARTIFICIAL
  Antibody
EVQLLESGGGLVQPGGSLRLSCAASGFTFSSYIMIWVRQAPGKGLEWVSSIYPSGGQTYYADSVKGRFTISRDNSKNTLYLQMNSLRAEDMAVYYCARKNGYNNVFDVWGQGTMVTVSS

SEQ ID NO: 403 - DNA, 357 bp, ARTIFICIAL
  Antibody
gaagttcaattgttagagtctggtggcggtcttgttcagcctggtggttctttacgtctttcttgcgctgcttccggattcactttctcttcttacattatgatttgggttcgccaagctcctggtaaaggtttggagtgggtttcttctatctatccttctggtggccagacttattatgctgactccgttaaaggtcgcttcactatctctagagacaactctaagaatactctctacttgcagatgaacagcttaagggctgaggacatggctgtgtattactgtgcaagaaaaaatggctacaataatgtatttgatgtctggggccaagggacaatggtcaccgtctcaagc

SEQ ID NO: 404 - protein, 110 aa, ARTIFICIAL
  Antibody
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTYVFGTGTKVTVL

SEQ ID NO: 405 - DNA, 330 bp, ARTIFICIAL
  Antibody
cagagcgctttgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcacttatgtcttcggaactgggaccaaggtcaccgtccta

SEQ ID NO: 406 - protein, 123 aa, ARTIFICIAL
  Antibody
EVQLLESGGGLVQPGGSLRLSCAASGFTFSRYPMLWVRQAPGKGLEWVSSIYPSGGWTSYADSVKGRFTISRDNSKNTLYLQMNSLRAEDTAVYYCTTPTHNWNDDPDAFDIWGQGTTVTVSS

SEQ ID NO: 407 - DNA, 369 bp, ARTIFICIAL
  Antibody
gaagttcaattgttagagtctggtggcggtcttgttcagcctggtggttctttacgtctttcttgcgctgcttccggattcactttctctcgttaccctatgctttgggttcgccaagctcctggtaaaggtttggagtgggtttcttctatctatccttctggtggctggacttcttatgctgactccgttaaaggtcgcttcactatctctagagacaactctaagaatactctctacttgcagatgaacagcttaagggctgaggacacagccgtgtattactgtaccacccctacccacaactggaacgatgaccctgatgcttttgatatctggggccaagggaccacggtcaccgtctcaagc

SEQ ID NO: 408 - protein, 107 aa, ARTIFICIAL
  Antibody
QSVLTQPPSVSVAPGQTATITCGGNNIGTKSVHWYQQKPGQAPVFVYDDNDRPSGIPERFSGSNSGNTATMTISRVEAGDEADYYCQVWDPTGDQYVFGSGTKVTVL

SEQ ID NO: 409 - DNA, 321 bp, ARTIFICIAL
  Antibody
cagagcgtcttgactcagccaccctcggtgtcagtggccccaggacagacggccacgattacctgtgggggaaacaacattggaactaaaagtgtacactggtaccagcagaagccaggccaggcccctgtcttcgtctatgatgataatgaccggccctcagggatccctgagcgattctctggctccaactccgggaacacggccaccatgaccatcagcagggtcgaagccggggatgaggccgactattattgtcaggtgtgggatcctactggtgatcagtatgtcttcggaagtgggaccaaggtcaccgtccta

SEQ ID NO: 410 - protein, 123 aa, ARTIFICIAL
  Antibody
EVQLLESGGGLVQPGGSLRLSCAASGFTFSKYKMLWVRQAPGKGLEWVSVIYPSGGYTYYADSVKGRFTISRDNSKNTLYLQMNSLRAEDTAVYYCARVVVPAFYYYYYMDVWGKGTTVTVSS

SEQ ID NO: 411 - DNA, 369 bp, ARTIFICIAL
  Antibody
gaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttctgttatctatccttctggtggctatacttactatgctgactccgttaaaggtcgcttcactatctctagagacaactctaagaatactctctacttgcagatgaacagcttaagggctgaggacacggccgtgtattactgtgcgagagtagtagtaccagctttctactactactactacatggacgtctggggcaaagggaccacggtcaccgtctcaagc

SEQ ID NO: 412 - protein, 112 aa, ARTIFICIAL
  Antibody
QSELTQPASVSGSPGQSITISCTGTSSDVGGYNYVSWYQQHPGKAPKLMIYEVSNRPSGVSNRFSGSKSGNTASLTISGLQAEDEADYYCSSYTSSSTLGGVFGGGTKLTVL

SEQ ID NO: 413 - DNA, 336 bp, ARTIFICIAL
  Antibody
cagagcgaattgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctcgggggggtattcggcggagggaccaagctgaccgtccta

SEQ ID NO: 414 - protein, 117 aa, ARTIFICIAL
  Antibody
EVQLLESGGGLVQPGGSLRLSCAASGFTFSKYKMDWVRQAPGKGLEWVSSIYPSGGFTYYADSVKGRFTISRDNSKNTLYLQMNSLRAEDTAVYYCAREKMATMDYWGQGTLVTVSS

SEQ ID NO: 415 - DNA, 351 bp, ARTIFICIAL
  Antibody
gaagttcaattgttagagtctggtggcggtcttgttcagcctggtggttctttacgtctttcttgcgctgcttccggattcactttctctaagtacaagatggattgggttcgccaagctcctggtaaaggtttggagtgggtttcttctatctatccttctggtggctttacttattatgctgactccgttaaaggtcgcttcactatctctagagacaactctaagaatactctctacttgcagatgaacagcttaagggctgaggacacggccgtgtattactgtgcaagagagaagatggctacaatggactactggggccagggcaccctggtcaccgtctcaagc

SEQ ID NO: 416 - protein, 109 aa, ARTIFICIAL
  Antibody
QYELTQPASVSGSPGQSITISCTGTSSDVGGCNYVSWYQQHPGKAPQLLIYDVSYRPSGVSNRFSGSKSGNTASLTISGLQADDEADYYCSSCTSSSTLFGTGTKVTVL

SEQ ID NO: 417 - DNA, 327 bp, ARTIFICIAL
  Antibody
cagtacgaattgactcaacctgcctccgtgtctgggtctcctggacagtcgatcaccatctcctgcactggaaccagcagtgacgttggtggttgtaactatgtctcctggtaccaacaacacccaggcaaagccccccaactcttgatttatgatgtcagttatcggccctcaggggtttctaatcgcttctctggctccaagtctggcaacacggcctccctgaccatctctgggctccaggctgacgacgaggctgattactactgcagctcatgtacaagtagcagcactctcttcggaactgggaccaaggtcaccgtccta

SEQ ID NO: 418 - protein, 119 aa, ARTIFICIAL
  Antibody
EVQLLESGGGLVQPGGSLRLSCAASGFTFSRYVMHWVRQAPGKGLEWVSRIYPSGGWTYYADSVKGRFTISRDNSKNTLYLQMNSLRAEDTAVYYCARVAGESNGMDVWGQGTTVTVSS

SEQ ID NO: 419 - DNA, 357 bp, ARTIFICIAL
  Antibody
gaagttcaattgttagagtctggtggcggtcttgttcagcctggtggttctttacgtctttcttgcgctgcttccggattcactttctctcgttacgttatgcattgggttcgccaagctcctggtaaaggtttggagtgggtttctcgtatctatccttctggtggctggacttattatgctgactccgttaaaggtcgcttcactatctctagagacaactctaagaatactctctacttgcagatgaacagcttaagggctgaggacacggccgtgtattactgtgcgagagtggctggggagtcgaacggtatggacgtctggggccaagggaccacggtcaccgtctcaagc

SEQ ID NO: 420 - protein, 108 aa, ARTIFICIAL
  Antibody
QDIQMTQSPSSLSASIGDRVTVTCRTSQSIDTYLNWYQQKPGQAPNLLIYGASSLESGVPSRFSGSGSGTDFTLTISSLQPEDFATYYCQQSYTTSYTFGRGTTLEIQ

SEQ ID NO: 421 - DNA, 324 bp, ARTIFICIAL
  Antibody
caagacatccagatgacccagtctccatcctccctgtcagcatctataggagacagagtcaccgtcacttgccggacaagtcagagcattgacacctatttaaattggtatcagcaaaaaccagggcaagcccctaacctcctgatctatggtgcatccagtttggaaagtggggtcccatcaaggttcagtggcagtggatctgggacagatttcactctcaccatcagcagtctgcaacctgaagattttgcaacttactactgtcaacagagttacactacctcctacacttttggccgggggaccacgctggagatccaa

SEQ ID NO: 422 - protein, 126 aa, ARTIFICIAL
  Antibody
EVQLLESGGGLVQPGGSLRLSCAASGFTFSIYKMQWVRQAPGKGLEWVSSIYPSGGATYYADSVKGRFTISRDNSKNTLYLQMNSLRAEDTAVYYCARQTYYYDSSGYFRNAFDIWGQGTMVTVSS

SEQ ID NO: 423 - DNA, 378 bp, ARTIFICIAL
  Antibody
gaagttcaattgttagagtctggtggcggtcttgttcagcctggtggttctttacgtctttcttgcgctgcttccggattcactttctctatttacaagatgcagtgggttcgccaagctcctggtaaaggtttggagtgggtttcttctatctatccttctggtggcgctacttattatgctgactccgttaaaggtcgcttcactatctctagagacaactctaagaatactctctacttgcagatgaacagcttaagggctgaggacacggccgtgtattactgtgcgagacaaacgtattactatgatagtagtggttatttccgcaatgcttttgatatctggggccaagggacaatggtcaccgtctcaagc

SEQ ID NO: 424 - protein, 105 aa, ARTIFICIAL
  Antibody
QSVLTQAASVSGSPGQSITLSCTGATRDVSWYQQHPGKAPKLVLYEVNSRPSDVSDRFSGSMSGNTASLTISGLQAEDEADYYCSSTTSRAPRVIFGGGTKLTVL

SEQ ID NO: 425 - DNA, 315 bp, ARTIFICIAL
  Antibody
cagagcgtcttgactcaggctgcctccgtgtctgggtctcctggacagtcgatcaccctctcctgcactggagccaccagggacgtctcctggtaccaacaacacccaggcaaggcccccaaactcgtcctttatgaagtcaatagtcgcccctcagacgtttccgatcgcttctctggctccatgtctggcaacacggcctccctgaccatctctggactccaggctgaagacgaggctgattattactgctcctcaaccacaagtcgcgcccctcgcgtgattttcggcggagggaccaaactgaccgtccta

SEQ ID NO: 426 - protein, 121 aa, ARTIFICIAL
  Antibody
EVQLLESGGGLVQPGGSLRLSCAASGFTFSRYRMVWVRQAPGKGLEWVSWIYPSGGWTSYADSVKGRFTISRDNSKNTLYLQMNSLRAEDTAVYYCARSNYYDSAATLDIWGQGTMVTVSS

SEQ ID NO: 427 - DNA, 363 bp, ARTIFICIAL
  Antibody
gaagttcaattgttagagtctggtggcggtcttgttcagcctggtggttctttacgtctttcttgcgctgcttccggattcactttctctcgttaccgtatggtttgggttcgccaagctcctggtaaaggtttggagtgggtttcttggatctatccttctggtggctggacttcttatgctgactccgttaaaggtcgcttcactatctctagagacaactctaagaatactctctacttgcagatgaacagcttaagggctgaggacacggccgtgtattactgtgcgaggtcaaattactatgatagtgctgcgactcttgatatctggggccaagggacaatggtcaccgtctcaagc

SEQ ID NO: 428 - protein, 107 aa, ARTIFICIAL
  Antibody
QDIQMTQSPSSLSASVGDRVTITCRASQTISSYLNWYQQKPGKAPKLLISAASTLQSGVPSRFSGSGSGTDFTLTISSLQPEDFATYYCQQSYSTPSFGQGTKVEIK

SEQ ID NO: 429 - DNA, 321 bp, ARTIFICIAL
  Antibody
caagacatccagatgacccagtctccatcctccctgtctgcatctgtaggagacagagtcaccatcacttgccgggcaagtcagaccattagcagctatttaaattggtatcagcagaaaccagggaaagcccctaagctcctgatctctgctgcatccactttgcaaagtggggtcccatcaaggttcagtggcagtggatctgggacagatttcactctcaccatcagcagtctgcaacctgaagattttgcaacttactactgtcaacagagttacagtaccccctcgttcggccaagggaccaaggtggaaatcaaa

SEQ ID NO: 430 - protein, 126 aa, ARTIFICIAL
  Antibody
EVQLLESGGGLVQPGGSLRLSCAASGFTFSHYQMLWVRQAPGKGLEWVSSIYPSGGWTYYADSVKGRFTISRDNSKNTLYLQMNSLRAEDTAVYYCARVGYSSGWYALTSKTFDYWGQGTLVTVSS

SEQ ID NO: 431 - DNA, 378 bp, ARTIFICIAL
  Antibody
gaagttcaattgttagagtctggtggcggtcttgttcagcctggtggttctttacgtctttcttgcgctgcttccggattcactttctctcattaccagatgctttgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacacggccgtgtattactgtgcgagagtggggtatagcagtggctggtacgcgttgacttcaaagacttttgactactggggccagggaaccctggtcaccgtctcaagc

SEQ ID NO: 432 - protein, 106 aa, ARTIFICIAL
  Antibody
QDIQMTQSPATLSLSPGDRAILSCRASHNIDNFLAWYQQKPGQAPRLLIYDASHRATGIPPRFSGSGSGTDFTLTISSLEPEDFAVYFCQQRTNWLFGGGTKVEIK

SEQ ID NO: 433 - DNA, 318 bp, ARTIFICIAL
  Antibody
caagacatccagatgacccagtctccagccaccctgtctttgtctccgggggatcgagccatcctctcctgtagggccagtcacaatattgacaacttcttagcctggtatcaacagaaacctggccaggctcccaggctcctcatctatgatgcatctcatagggccactggcatccccccccggttcagtggcagtgggtctgggacagacttcactctcaccatcagcagcctagaacctgaagattttgctgtgtatttctgtcaacaacggaccaactggcttttcggcggagggaccaaggtggagatcaaa

SEQ ID NO: 434 - protein, 117 aa, ARTIFICIAL
  Antibody
EVQLLESGGGLVQPGGSLRLSCAASGFTFSRYPMNWVRQAPGKGLEWVSRIWPSGGSTVYADSVKGRFTISRDNSKNTLYLQMNSLRAEDTAVYYCARDSSRYFDVWGRGTLVTVSS

SEQ ID NO: 435 - DNA, 351 bp, ARTIFICIAL
  Antibody
gaagttcaattgttagagtctggtggcggtcttgttcagcctggtggttctttacgtctttcttgcgctgcttccggattcactttctctcgttaccctatgaattgggttcgccaagctcctggtaaaggtttggagtgggtttctcgtatctggccttctggtggctctactgtttatgctgactccgttaaaggtcgcttcactatctctagagacaactctaagaatactctctacttgcagatgaacagcttaagggctgaggacacggccgtgtattactgtgcgagagattcttctcgatacttcgatgtctggggccgtggcaccctggtcaccgtctcaagc

SEQ ID NO: 436 - protein, 108 aa, ARTIFICIAL
  Antibody
QDIQMTQSPATLSVSPGERATLSCRASQSISSNLAWYQQKPGQAPRLLIYGTSTRATGIPARFSGSGSGTEFTLTISSLQSEDFVVYYCQQYKDWPLTFGGGTTVEIK

SEQ ID NO: 437 - DNA, 324 bp, ARTIFICIAL
  Antibody
caagacatccagatgacccagtctccagccaccctgtctgtgtctccaggggaaagagccaccctctcctgcagggccagtcagagtattagcagtaatttagcctggtaccaacaaaaacctggccaggctcccaggctcctcatctatggtacatccaccagggccactggtatcccagccaggttcagtggcagtgggtctgggaccgagttcactctcaccatcagcagcctgcagtctgaagattttgtagtttattactgtcagcagtataaagactggcctctcactttcggcggagggaccacggtggagatcaag

SEQ ID NO: 438 - protein, 117 aa, ARTIFICIAL
  Antibody
EVQLLESGGGLVQPGGSLRLSCAASGFTFSNYKMHWVRQAPGKGLEWVSVIYPSGGVTEYADSVKGRFTISRDNSKNTLYLQMNSLRAEDTAVYYCARDQYSGHDYWGQGTLVTVSS

SEQ ID NO: 439 - DNA, 351 bp, ARTIFICIAL
  Antibody
gaagttcaattgttagagtctggtggcggtcttgttcagcctggtggttctttacgtctttcttgcgctgcttccggattcactttctctaattacaagatgcattgggttcgccaagctcctggtaaaggtttggagtgggtttctgttatctatccttctggtggcgttactgagtatgctgactccgttaaaggtcgcttcactatctctagagacaactctaagaatactctctacttgcagatgaacagcttaagggctgaggacacggccgtgtattactgtgcgagagatcaatacagtggccatgactactggggccagggaaccctggtcaccgtctcaagc

SEQ ID NO: 440 - protein, 108 aa, ARTIFICIAL
  Antibody
QDIQMTQSPGTLSLSPGERATLSCRASQSVSSYLAWYQQKPGQAPRLLIYDASNRATGIPARFSGSGSGTDFTLTISSLEPEDFAVYYCQQRYSWPLTFGGGTKVEIK

SEQ ID NO: 441 - DNA, 324 bp, ARTIFICIAL
  Antibody
caagacatccagatgacccagtctccaggcaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgttacagctggcctctcactttcggcggagggaccaaggtggagatcaag

SEQ ID NO: 442 - protein, 117 aa, ARTIFICIAL
  Antibody
EVQLLESGGGLVQPGGSLRLSCAASGFTFSEYQMIWVRQAPGKGLEWVSYIVPSGGFTAYADSVKGRFTISRDNSKNTLYLQMNSLRAEDTAVYYCARVNYYGMDVWGQGTTVTVSS

SEQ ID NO: 443 - DNA, 351 bp, ARTIFICIAL
  Antibody
gaagttcaattgttagagtctggtggcggtcttgttcagcctggtggttctttacgtctttcttgcgctgcttccggattcactttctctgagtaccagatgatttgggttcgccaagctcctggtaaaggtttggagtgggtttcttatatcgttccttctggtggctttactgcttatgctgactccgttaaaggtcgcttcactatctctagagacaactctaagaatactctctacttgcagatgaacagcttaagggctgaggacacggccgtgtattactgtgcgagagtgaactactacggtatggacgtctggggccaagggaccacggtcaccgtctcaagc

SEQ ID NO: 444 - protein, 110 aa, ARTIFICIAL
  Antibody
QSALTQPASVSGSPGQSISISCTGTNTDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 445 - DNA, 330 bp, ARTIFICIAL
  Antibody
cagagcgctttgactcagcctgcctccgtgtctgggtctcctggacagtcgatcagcatctcctgcactggaaccaacactgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagtagtagcacttgggtgttcggcggagggaccaagctgaccgtccta

SEQ ID NO: 446 - protein, 127 aa, ARTIFICIAL
  Antibody
EVQLLESGGGLVQPGGSLRLSCAASGFTFSAYLMEWVRQAPGKGLEWVSGIYPSGGKTYYADSVKGRFTISRDNSKNTLYLQMNSLRAEDTAVYYCARVNVISVAGTGYYYYGMDVWGQGTTVTVSS

SEQ ID NO: 447 - DNA, 381 bp, ARTIFICIAL
  Antibody
gaagttcaattgttagagtctggtggcggtcttgttcagcctggtggttctttacgtctttcttgcgctgcttccggattcactttctctgcttaccttatggagtgggttcgccaagctcctggtaaaggtttggagtgggtttctggtatctatccttctggtggcaagacttattatgctgactccgttaaaggtcgcttcactatctctagagacaactctaagaatactctctacttgcagatgaacagcttaagggctgaggacacggccgtgtattactgtgcgagagtgaacgttatatcagtggctggtactggctactactactacggtatggacgtctggggccaagggaccacggtcaccgtctcaagc

SEQ ID NO: 448 - protein, 108 aa, ARTIFICIAL
  Antibody
QDIQMTQSPATLSLSPGERATLSCRASQSVSIYLAWYQQKPGQAPRLLIYDASNRATDIPARFSGSGSGTDFTLTISSLEPEDFAVYYCQQRSSWPITFGLGTRLEIK

SEQ ID NO: 449 - DNA, 324 bp, ARTIFICIAL
  Antibody
caagacatccagatgacccagtctccagccaccctgtctttgtctccaggggaaagagccaccctctcctgcagggccagtcagagtgttagcatctacttagcctggtaccaacagaaacctggtcaggctcccaggctcctcatctatgatgcatccaacagggccactgacatcccagccaggttcagtggcagtgggtctgggacagacttcactctcaccatcagcagcctagagcctgaagattttgcagtttattactgtcagcaacgtagcagctggccgatcaccttcggccttgggacacgactggagattaaa

SEQ ID NO: 450 - protein, 119 aa, ARTIFICIAL; identical to SEQ ID NO: 262
  Antibody

SEQ ID NO: 451 - DNA, 357 bp, ARTIFICIAL; identical to SEQ ID NO: 263
  Antibody

SEQ ID NO: 452 - protein, 108 aa, ARTIFICIAL
  Antibody
QDIQMTQSPSSLSASVGDGVTITCRASQSINNHLNWYQQKPGKAPKVLIYAASSLQSGVPSRFSGSGSGTDFTLTISSLQPEDFATYYCQQSYSTPWTFGQGTKVEIK

SEQ ID NO: 453 - DNA, 324 bp, ARTIFICIAL
  Antibody
caagacatccagatgacccagtctccatcctccctgtctgcatctgtaggagacggagtcaccatcacttgccgggcaagtcagagcattaacaaccatttaaattggtatcagcagaaaccagggaaagcccctaaggtcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtggacgttcggccaagggaccaaggtggaaatcaaa

SEQ ID NO: 454 - protein, 127 aa, ARTIFICIAL
  Antibody
EVQLLESGGGLVQPGGSLRLSCAASGFTFSKYRMSWVRQAPGKGLEWVSGIYPSGGGTTYADSVKGRFTISRDNSKNTLYLQMNSLRAEDTAVYYCARPTYYYDSSGYYYSGPIDYWGQGTLVTVSS

SEQ ID NO: 455 - DNA, 381 bp, ARTIFICIAL
  Antibody
gaagttcaattgttagagtctggtggcggtcttgttcagcctggtggttctttacgtctttcttgcgctgcttccggattcactttctctaagtaccgtatgtcttgggttcgccaagctcctggtaaaggtttggagtgggtttctggtatctatccttctggtggcggtactacttatgctgactccgttaaaggtcgcttcactatctctagagacaactctaagaatactctctacttgcagatgaacagcttaagggctgaggacacggccgtgtattactgtgcgagacccacgtattactatgatagtagtggttattactactcggggcctattgactactggggccagggaaccctggtcaccgtctcaagc

SEQ ID NO: 456 - protein, 110 aa, ARTIFICIAL
  Antibody
QYELTQPASVSGSPGQSITISCTGTNTDVGGYNLVSWYQQHPGKAPKLIIYEVSNRPSGVSNRFSGSKSGNTASLTISGLQAEDEVDYYCGSYTSSSTHVFGSGTKVTVL

SEQ ID NO: 457 - DNA, 330 bp, ARTIFICIAL
  Antibody
cagtacgaattgactcagcctgcctccgtgtctgggtctcctggacagtcgatcaccatctcctgcactggaaccaacactgacgttggtggttataaccttgtctcctggtaccaacagcacccaggcaaagcccccaaactcataatttatgaggtcagtaatcggccctcaggggtttctaatcgcttctctggctccaagtctggcaacacggcctccctgaccatctctgggctccaggctgaggacgaggttgattattattgcggctcatatacaagcagcagtactcatgtcttcggaagtgggaccaaggtcaccgtccta

SEQ ID NO: 458 - protein, 117 aa, ARTIFICIAL
  Antibody
EVQLLESGGGLVQPGGSLRLSCAASGFTFSAYKMHWVRQAPGKGLEWVSVIYPSGGWTYYADSVKGRFTISRDNSKNTLYLQMNSLRAEDTAVYYCARGTAGWFDPWGQGTLVTVSS

SEQ ID NO: 459 - DNA, 351 bp, ARTIFICIAL
  Antibody
gaagttcaattgttagagtctggtggcggtcttgttcagcctggtggttctttacgtctttcttgcgctgcttccggattcactttctctgcttacaagatgcattgggttcgccaagctcctggtaaaggtttggagtgggtttctgttatctatccttctggtggctggacttattatgctgactccgttaaaggtcgcttcactatctctagagacaactctaagaatactctctacttgcagatgaacagcttaagggctgaggacacggccgtgtattactgtgcaagagggactgcagggtggttcgacccttggggccagggaaccctggtcaccgtctcaagc

SEQ ID NO: 460 - protein, 110 aa, ARTIFICIAL
  Antibody
QSELTQPASVSGSPGQSITISCTGTSSDVGSYNLVSWYQQHPGKAPKLMIYEGSKRPSGVSNRFSGSKSGNTASLTISGLQAEDEADYYCCSYAGSSTYVFGTGTKVTVL

SEQ ID NO: 461 - DNA, 330 bp, ARTIFICIAL
  Antibody
cagagcgaattgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcacttatgtcttcggaactgggaccaaggtcaccgtccta

SEQ ID NO: 462 - protein, 117 aa, ARTIFICIAL
  Antibody
EVQLLESGGGLVQPGGSLRLSCAASGFTFSNYKMTWVRQAPGKGLEWVSSIYPSGGWTYYADSVKGRFTISRDNSKNTLYLQMNSLRAEDTAMYYCARQEDGGYGTWGQGTLVTVSS

SEQ ID NO: 463 - DNA, 351 bp, ARTIFICIAL
  Antibody
gaagttcaattgttagagtctggtggcggtcttgttcagcctggtggttctttacgtctttcttgcgctgcttccggattcactttctctaattacaagatgacttgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacaccgccatgtattactgtgcgagacaggaggatggtggctacgggacttggggccagggaaccctggtcaccgtctcaagc

SEQ ID NO: 464 - protein, 108 aa, ARTIFICIAL
  Antibody
QSVLTQDPAVSVALGQTVRITCQGDSLRSYYATWYQQKPGQAPVLVIYGENNRPSGIPDRFSGSSSGNTGSLTITGAQAEDEADYYCNSRDTSGSHLLFGGGTKLTVL

SEQ ID NO: 465 - DNA, 324 bp, ARTIFICIAL
  Antibody
cagagcgtcttgactcaggaccctgctgtgtctgtggccttgggacagacagtcaggatcacatgccaaggagacagcctcagaagctattatgcaacctggtaccaacagaagccaggacaggcccctgtacttgtcatctatggtgaaaacaaccggccctcagggatcccagaccgattctctggctccagttcaggaaacacaggttccttgaccatcactggggctcaggcggaagatgaggctgactattactgtaactcccgggacaccagtggtagtcatctattattcggcggagggaccaagctgaccgtcctg

SEQ ID NO: 466 - protein, 125 aa, ARTIFICIAL
  Antibody
EVQLLESGGGLVQPGGSLRLSCAASGFTFSQYKMLWVRQAPGKGLEWVSSIYPSGGWTSYADSVKGRFTISRDNSKNTLYLQMNSLRAEDTAVYYCARASYYDSGGYYRENFQFWGQGTLVTVSS

SEQ ID NO: 467 - DNA, 375 bp, ARTIFICIAL
  Antibody
gaagttcaattgttagagtctggtggcggtcttgttcagcctggtggttctttacgtctttcttgcgctgcttccggattcactttctctcagtacaagatgctttgggttcgccaagctcctggtaaaggtttggagtgggtttcttctatctatccttctggtggctggacttcttatgctgactccgttaaaggtcgcttcactatctctagagacaactctaagaatactctctacttgcagatgaacagcttaagggctgaggacacggccgtgtattactgtgcgagagcctcttactatgatagtggaggttattaccgagaaaacttccagttttggggccagggcaccctggtcaccgtctcaagc

SEQ ID NO: 468 - protein, 110 aa, ARTIFICIAL
  Antibody
QDIQMTQSPSSLSASVGDRVTIICRASQSISIYLNWYQQKPGKAPKVLIYDASSLQSGVPSRFSGSGSGTDFSLTITSLQPEDFATYYCQQSYSTPPMYTFGQGTKLEIK

SEQ ID NO: 469 - DNA, 330 bp, ARTIFICIAL
  Antibody
caagacatccagatgacccagtctccatcctccctgtctgcatctgtaggagacagagtcaccatcatttgccgggcaagtcagagcatcagcatctatttaaattggtatcagcagaaaccagggaaagcccctaaggtcctgatatatgatgcatccagtttgcaaagtggggtcccatcaaggttcagtggcagtggatctgggacagatttcagtctcaccatcaccagtctgcaacctgaagattttgcaacttactactgtcaacagagttacagtacccctcccatgtacacttttggccaggggaccaagctggagatcaaa

SEQ ID NO: 470 - protein, 119 aa, ARTIFICIAL
  Antibody
EVQLLESGGGLVQPGGSLRLSCAASGFTFSSYKMHWVRQAPGKGLEWVSVIYPSGGATYYADSVKGRFTISRDNSKNTLYLQMNSLRAEDTATYYCAKGLDFWSGPDYWGQGTLVTVSS

SEQ ID NO: 471 - DNA, 357 bp, ARTIFICIAL
  Antibody
gaagttcaattgttagagtctggtggcggtcttgttcagcctggtggttctttacgtctttcttgcgctgcttccggattcactttctcttcttacaagatgcattgggttcgccaagctcctggtaaaggtttggagtgggtttctgttatctatccttctggtggcgctacttattatgctgactctgttaaaggtcgcttcactatctctagagacaactctaagaatactctctacttgcagatgaacagcttaagggctgaggacacagccacatattactgtgcaaaagggctcgatttttggagtggcccggactactggggccagggcaccctggtcaccgtctcaagc

SEQ ID NO: 472 - protein, 108 aa, ARTIFICIAL
  Antibody
QDIQMTQSPSSLSASVGDRVTITCWASQDIRTSLAWYQQKPGKPPKLLIFAASTLQGGVPSRFSGSGSGTEFTLTISGLQPEDFATYYCQHLNGYPLTFGDGTKVEIR

SEQ ID NO: 473 - DNA, 324 bp, ARTIFICIAL
  Antibody
caagacatccagatgacccagtctccatcctccctgtctgcatctgtaggagacagagtcaccatcacttgctgggccagtcaggatattcgcacttctttagcctggtatcagcagaaaccagggaaaccccctaaactcctcatctttgctgcgtctactttgcaaggtggggtcccatcaaggttcagcggcagtggatctgggacagaattcactctcacaatctccggcctgcagcctgaggattttgcgacttattactgtcagcaccttaatggttacccgctcactttcggcgatgggaccaaggtggagatcaga

SEQ ID NO: 474 - protein, 119 aa, ARTIFICIAL
  Antibody
EVQLLESGGGLVQPGGSLRLSCAASGFTFSNYVMQWVRQAPGKGLEWVSVIYPSGGMTNYADSVKGRFTISRDNSKNTLYLQMNSLRAEDTATYYCARIRGDTRAFDIWGQGTMVTVSS

SEQ ID NO: 475 - DNA, 357 bp, ARTIFICIAL
  Antibody
gaagttcaattgttagagtctggtggcggtcttgttcagcctggtggttctttacgtctttcttgcgctgcttccggattcactttctctaattacgttatgcagtgggttcgccaagctcctggtaaaggtttggagtgggtttctgttatctatccttctggtggcatgactaattatgctgactccgttaaaggtcgcttcactatctctagagacaactctaagaatactctctacttgcagatgaacagcttaagggctgaggacacagccacgtattactgtgcacggatacgcggtgacaccagggcttttgatatctggggccaagggacaatggtcaccgtctcaagc

SEQ ID NO: 476 - protein, 110 aa, ARTIFICIAL
  Antibody
QDIQMTQSPGTLSLSPGERATLSCRASQSVSSSYLAWYQQKPGQAPRLLIYGASSRATGIPDRFSGSGSGTDFTLTISRLEPEDLAVYYCQLFGSSPRITFGQGTRLEIK

SEQ ID NO: 477 - DNA, 330 bp, ARTIFICIAL
  Antibody
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagatttggcagtatattactgtcagctgtttggaagctctcctcggatcaccttcggccaggggacgcggctggaaattaaa

SEQ ID NO: 478 - protein, 125 aa, ARTIFICIAL
  Antibody
EVQLLESGGGLVQPGGSLRLSCAASGFTFSKYKMWWVRQAPGKGLEWVSVIYPSGGATYYADSVKGRFTISRDNSKNTLYLQMNSLRAEDTAVYYCARSSLGCSSTSCYDAFDIWGQGTMVTVSS

SEQ ID NO: 479 - DNA, 375 bp, ARTIFICIAL
  Antibody
gaagttcaattgttagagtctggtggcggtcttgttcagcctggtggttctttacgtctttcttgcgctgcttccggattcactttctctaagtacaagatgtggtgggttcgccaagctcctggtaaaggtttggagtgggtttctgttatctatccttctggtggcgctacttattatgctgactccgttaaaggtcgcttcactatctctagagacaactctaagaatactctctacttgcagatgaacagcttaagggctgaggacacggccgtgtattactgtgcgaggtcttctctagggtgtagtagtaccagctgctatgatgcttttgatatctggggccaagggacaatggtcaccgtctcaagc

SEQ ID NO: 480 - protein, 108 aa, ARTIFICIAL
  Antibody
QDIQMTQSPSSLSASVGDRVTITCRASQGISNYLAWYQQKPGKVPKLLIYAASTLQSGVPSRFSGSGSGTDFTLTISSLQPEDVATYYCQKYNSAPWTFGQGTKVEIK

SEQ ID NO: 481 - DNA, 324 bp, ARTIFICIAL
  Antibody
caagacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgccccctggacgttcggccaagggaccaaggtggaaatcaaa

SEQ ID NO: 482 - protein, 120 aa, ARTIFICIAL
  Antibody
EVQLLESGGGLVQPGGSLRLSCAASGFTFSTYGMWWVRQAPGKGLEWVSSISSGGSTVYADSVKGRFTISRDNSKNTLYLQMNSLRAEDTAVYYCARDLTTVTGNYFDYWGQGTLVTVSS

SEQ ID NO: 483 - DNA, 360 bp, ARTIFICIAL
  Antibody
gaagttcaattgttagagtctggtggcggtcttgttcagcctggtggttctttacgtctttcttgcgctgcttccggattcactttctctacttacggtatgtggtgggttcgccaagctcctggtaaaggtttggagtgggtttcttctatctcttctggtggctctactgtttatgctgactccgttaaaggtcgcttcactatctctagagacaactctaagaatactctctacttgcagatgaacagcttaagggctgaggacacggccgtgtattactgtgcgagagatctgactacggtgacggggaactactttgactactggggccagggaaccctggtcaccgtctcaagc

SEQ ID NO: 484 - protein, 110 aa, ARTIFICIAL
  Antibody
QDIQMTQSPGTLSLSPGERATLSCRASQSVSSSQLAWYQHKRGQPPRLLIYGASSRATGIPDRFSGSGSGTDYILTISRLEPEDFAVYYCQHFGSSPPATFGQGTKVEIK

SEQ ID NO: 485 - DNA, 330 bp, ARTIFICIAL
  Antibody
caagacatccagatgacccagtctccaggcaccctatctttgtctccaggggaaagagccaccctctcctgcagggccagtcagagtgtttccagcagccagttagcctggtaccagcataaacgtggccagcctcccaggctcctcatctatggtgcatccagcagggccactggcatcccagacaggttcagtggcagtgggtctgggacagactacattctcaccatcagcagactggagcctgaagattttgcagtgtattactgtcagcattttggtagttcacctccggcgacgttcggccaagggaccaaggtggaaatcaaa

SEQ ID NO: 486 - protein, 125 aa, ARTIFICIAL
  Antibody
EVQLLESGGGLVQPGGSLRLSCAASGFTFSSYKMVWVRQAPGKGLEWVSSIYPSGGVTIYADSVKGRFTISRDNSKNTLYLQMNSLRAEDTAVYYCARDGSSSGWYNPRRAFDYWGQGTLVTVSS

SEQ ID NO: 487 - DNA, 375 bp, ARTIFICIAL
  Antibody
gaagttcaattgttagagtctggtggcggtcttgttcagcctggtggttctttacgtctttcttgcgctgcttccggattcactttctcttcttacaagatggtttgggttcgccaagctcctggtaaaggtttggagtgggtttcttctatctatccttctggtggcgttactatttatgctgactccgttaaaggtcgcttcactatctctagagacaactctaagaatactctctacttgcagatgaacagcttaagggctgaggacacggccgtgtattactgtgcgagagatggaagtagcagtggctggtacaatccccgtagggcctttgactactggggccagggaaccctggtcaccgtctcaagc

SEQ ID NO: 488 - protein, 106 aa, ARTIFICIAL
  Antibody
QYELTQPPSLSVSPGQTVKITCSAEKLSEKYVAWYQQRPGQSPVMVIYQDSRRPSGIPERFSGSNSGNTATLTISGTQPMDEADYYCQAWFSDSLPFGSGTKVTVL

SEQ ID NO: 489 - DNA, 318 bp, ARTIFICIAL
  Antibody
cagtacgaattgactcagccaccctctctgtccgtgtccccaggacagacagtcaagatcacctgctctgcagagaagttgagtgagaaatatgttgcttggtatcaacagaggccgggccagtcccctgtcatggtcatctatcaagatagtaggcggccctcagggatccctgagcgattctctggctccaactctgggaacacagccactctgaccatcagcgggacccagcccatggatgaggctgactactattgtcaggcgtggtttagcgacagtctcccctttggaagtgggaccaaggtcaccgtccta

SEQ ID NO: 490 - protein, 119 aa, ARTIFICIAL
  Antibody
EVQLLESGGGLVQPGGSLRLSCAASGFTFSKYKMIWVRQAPGKGLEWVSSIYPSGGHTIYADSVKGRFTISRDNSKNTLYLQMNSLRAEDTAMYYCAREGGGATSFDYWGQGTLVTVSS

SEQ ID NO: 491 - DNA, 357 bp, ARTIFICIAL
  Antibody
gaagttcaattgttagagtctggtggcggtcttgttcagcctggtggttctttacgtctttcttgcgctgcttccggattcactttctctaagtacaagatgatctgggttcgccaagctcctggtaaaggtttggagtgggtttcttctatctatccttctggtggccatactatttatgctgactccgttaaaggtcgcttcactatctctagagacaactctaagaatactctctacttgcagatgaacagcttaagggctgaggacaccgccatgtattactgtgcgagagagggcgggggagctacctcctttgactactggggccagggaaccctggtcaccgtctcaagc

SEQ ID NO: 492 - protein, 108 aa, ARTIFICIAL
  Antibody
QDIQMTQSPATLSLSPGERATLSCRASQSVRTYLGWYQQKHGQAPRLLIYDASNRATGIPARFSGSGSGTDFTLTISSLEPEDFAVYYCQQRSNWPLTFGGGTKVEIK

SEQ ID NO: 493 - DNA, 324 bp, ARTIFICIAL
  Antibody
caagacatccagatgacccagtctccagccaccctgtctttgtctccaggggaaagagccaccctctcctgcagggccagtcagagtgttaggacctatttaggctggtaccaacagaaacatggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgctcactttcggcggagggaccaaggtggagatcaaa

SEQ ID NO: 494 - protein, 119 aa, ARTIFICIAL
  Antibody
EVQLLESGGGLVQPGGSLRLSCAASGFTFSAYPMFWVRQAPGKGLEWVSVISPSGGQTSYADSVKGRFTISRDNSKNTLYLQMNSLRAEDTAVYYCAKSFSGLAALDFWGQGTLVTVSS

SEQ ID NO: 495 - DNA, 357 bp, ARTIFICIAL
  Antibody
gaagttcaattgttagagtctggtggcggtcttgttcagcctggtggttctttacgtctttcttgcgctgcttccggattcactttctctgcttaccctatgttttgggttcgccaagctcctggtaaaggtttggagtgggtttctgttatctctccttctggtggccagacttcttatgctgactccgttaaaggtcgcttcactatctctagagacaactctaagaatactctctacttgcagatgaacagcttaagggctgaggacacggccgtgtattactgtgcgaaatcattctcaggcttagcagctcttgacttctggggccagggaaccctggtcaccgtctcaagc

SEQ ID NO: 496 - protein, 110 aa, ARTIFICIAL
  Antibody
QDIQMTQSPGTLSLSPGERATLSCRASQTVSSGSLAWYQQKPGLAPRLLIYGASRRGTGIPDRFSGSGSGTDFTLTISRLEPEDFAVYYCQQYGSTLPLTFGGGTKVEIK

SEQ ID NO: 497 - DNA, 330 bp, ARTIFICIAL
  Antibody
caagacatccagatgacccagtctccaggcaccctgtctttgtctccaggggaaagagccaccctctcctgcagggccagtcagacagtgagcagcggctccttagcctggtaccagcagaaacctggcctggctcccaggctcctcatctatggtgcatcccgtaggggcactggcatcccagacaggttcagtggcagtgggtctgggacagacttcactctcaccatcagcagactggagcctgaagattttgcagtgtactactgtcagcagtatggtagtacactcccgctcactttcggcggagggaccaaggtcgagatcaaa

SEQ ID NO: 498 - protein, 119 aa, ARTIFICIAL
  Antibody
EVQLLESGGGLVQPGGSLRLSCAASGFTFSQYTMYWVRQAPGKGLEWVSSIYPSGGWTNYADSVKGRFTISRDNSKNTLYLQMNSLRAEDMAVYYCARGRGGSKAFDIWGQGTMVTVSS

SEQ ID NO: 499 - DNA, 357 bp, ARTIFICIAL
  Antibody
gaagttcaattgttagagtctggtggcggtcttgttcagcctggtggttctttacgtctttcttgcgctgcttccggattcactttctctcagtacactatgtattgggttcgccaagctcctggtaaaggtttggagtgggtttcttctatctatccttctggtggctggactaattatgctgactccgttaaaggtcgcttcactatctctagagacaactctaagaatactctctacttgcagatgaacagcttaagggctgaggacatggctgtgtattactgtgcgagaggccgtggtggtagcaaagcttttgatatctggggccaagggacaatggtcaccgtctcaagc

SEQ ID NO: 500 - protein, 110 aa, ARTIFICIAL
  Antibody
QSELTQPASVSGSPGQSITISCTGTTSDVGGYNYVSWYQQDPGKVPKLIIYEVYNRPSGVSNRFSGSKSGNTASLTISGLRAEDEADYYCSSKTSSVTYVFGTGTKVTVL

SEQ ID NO: 501 - DNA, 330 bp, ARTIFICIAL
  Antibody
cagagcgaattgactcagcctgcctccgtgtctgggtctcctggacagtcgatcaccatctcctgcactggaaccaccagtgacgttggtggttataactatgtctcctggtatcaacaggacccaggcaaagtccccaaactcataatttatgaggtctataatcggccctcaggggtttcaaatcgcttctctggctccaagtctggcaacacggcctccctgaccatctctgggctccgggctgaggacgaggctgattattactgcagctcaaaaacaagcagcgtcacttatgtctttggaactgggaccaaggtcaccgtccta

SEQ ID NO: 502 - protein, 119 aa, ARTIFICIAL
  Antibody
EVQLLESGGGLVQPGGSLRLSCAASGFTFSAYVMSWVRQAPGKGLEWVSRIYPSGGGTRYADSVKGRFTISRDNSKNTLYLQMNSLRAEDTAVYYCAKEAGGSYFLDYWGQGTLVTVSS

SEQ ID NO: 503 - DNA, 357 bp, ARTIFICIAL
  Antibody
gaagttcaattgttagagtctggtggcggtcttgttcagcctggtggttctttacgtctttcttgcgctgcttccggattcactttctctgcttacgttatgtcttgggttcgccaagctcctggtaaaggtttggagtgggtttctcgtatctatccttctggtggcggtactcgttatgctgactccgttaaaggtcgcttcactatctctagagacaactctaagaatactctctacttgcagatgaacagcttaagggctgaggacacggccgtgtattactgtgcgaaagaggcgggtgggagctacttccttgactactggggccagggaaccctggtcaccgtctcaagc

SEQ ID NO: 504 - protein, 109 aa, ARTIFICIAL
  Antibody
QSELTQPRSVSGSLGQSVTISCTGTTSDVGRYNFVSWYQQYPGRAPKLIIHDVTRRPSGVSDRFSGSKSGNTASLTISGLQAEDEADYYCCSYAGSFYVFGSGTQVTVL

SEQ ID NO: 505 - DNA, 327 bp, ARTIFICIAL
  Antibody
cagagcgaattgactcagcctcgctcagtgtccgggtctcttggacagtcagtcaccatctcctgcactggaaccaccagtgatgttggtcgttataactttgtctcctggtaccaacagtatccaggcagagcccccaaactcatcattcatgatgtcactcggcggccctccggggtatctgatcgcttctctggctccaagtccggcaacacggcctccctgaccatctctggtctccaggctgaggatgaggctgattattactgctgctcatatgcaggcagcttttatgtcttcggatctgggacccaggtcaccgtcttg

SEQ ID NO: 506 - protein, 119 aa, ARTIFICIAL
  Antibody
EVQLLESGGGLVQPGGSLRLSCAASGFTFSSYKMIWVRQAPGKGLEWVSGIYPSGGATGYADSVKGRFTISRDNSKNTLYLQMNSLRAEDTATYYCARDGGDIVVPDYWGQGTLVTVSS

SEQ ID NO: 507 - DNA, 357 bp, ARTIFICIAL
  Antibody
gaagttcaattgttagagtctggtggcggtcttgttcagcctggtggttctttacgtctttcttgcgctgcttccggattcactttctcttcttacaagatgatttgggttcgccaagctcctggtaaaggtttggagtgggtttctggtatctatccttctggtggcgctactggttatgctgactccgttaaaggtcgcttcactatctctagagacaactctaagaatactctctacttgcagatgaacagcttaagggctgaggacacagccacgtattactgtgcgagagatgggggggatattgtagtgcctgactactggggccagggaaccctggtcaccgtctcaagc

SEQ ID NO: 508 - protein, 110 aa, ARTIFICIAL
  Antibody
QYELTQPPSASGTPGQRVTISCSGSSSNIGTNTVYWYQQLPGTAPKLLIYTNVQRPSGVPDRFSGSKSGTSASLAISGLQSEDEADYYCQSYDGSLSSAVFGGGTQLTVL

SEQ ID NO: 509 - DNA, 330 bp, ARTIFICIAL
  Antibody
cagtacgaattgactcagccaccctcagcgtctgggacccccgggcagagggtcaccatctcttgttctggaagcagctccaacatcggaactaatactgtatactggtaccagcagctcccaggaacggcccccaaactcctcatctatactaatgtccagcggccctcaggggtccctgaccgattctctggctccaagtctggcacctcagcctccctggccatcagtgggctccagtctgaggatgaggctgattattactgccagtcctatgacggcagcctgagttctgctgtgttcggaggaggcacccagctgaccgtcctc

SEQ ID NO: 510 - protein, 123 aa, ARTIFICIAL
  Antibody
EVQLLESGGGLVQPGGSLRLSCAASGFTFSKYHMGWVRQAPGKGLEWVSSIYSSGGITQYADSVKGRFTISRDNSKNTLYLQMNSLRAEDTAVYYCARGRVGGWSLFNWFDPWGQGTLVTVSS

SEQ ID NO: 511 - DNA, 369 bp, ARTIFICIAL
  Antibody
gaagttcaattgttagagtctggtggcggtcttgttcagcctggtggttctttacgtctttcttgcgctgcttccggattcactttctctaagtaccatatgggttgggttcgccaagctcctggtaaaggtttggagtgggtttcttctatctattcttctggtggcattactcagtatgctgactccgttaaaggtcgcttcactatctctagagacaactctaagaatactctctacttgcagatgaacagcttaagggctgaggacacggccgtgtattactgtgcaagaggccgagtcggtggctggtccctttttaactggttcgacccctggggccagggcaccctggtcaccgtctcaagc

SEQ ID NO: 512 - protein, 108 aa, ARTIFICIAL
  Antibody
QDIQMTQSPGTLSLSPGERATLSCRASQSVSSYLAWYQQKPGQAPRLLIYDASNRATGIPARFSGSGSGTDFTLTISSLEPEDFAVYYCQQRSNWPRTFGQGTKVEIK

SEQ ID NO: 513 - DNA, 324 bp, ARTIFICIAL
  Antibody
caagacatccagatgacccagtctccaggcaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcggacgttcggccaagggaccaaggtggaaatcaaa

SEQ ID NO: 514 - protein, 118 aa, ARTIFICIAL
  Antibody
EVQLLESGGGLVQPGGSLRLSCAASGFTFSSYPMYWVRQAPGKGLEWVSRIVPSGGWTNYADSVKGRFTISRDNSKNTLYLQMNSLRAEDTAVYYCARDKGDWYFDLWGRGTLVTVSS

SEQ ID NO: 515 - DNA, 354 bp, ARTIFICIAL
  Antibody
gaagttcaattgttagagtctggtggcggtcttgttcagcctggtggttctttacgtctttcttgcgctgcttccggattcactttctcttcttaccctatgtattgggttcgccaagctcctggtaaaggtttggagtgggtttctcgtatcgttccttctggtggctggactaactatgctgactccgttaaaggtcgcttcactatctctagagacaactctaagaatactctctacttgcagatgaacagcttaagggctgaggacacggccgtgtattactgtgcgagagataagggggactggtacttcgatctctggggccgtggcaccctggtcaccgtctcaagc

SEQ ID NO: 516 - protein, 110 aa, ARTIFICIAL
  Antibody
QDIQMTQSPATLSLSPGERATLSCRASQSVSRYLAWYQQKPGQAPRLLIYDTSNRATGIPARFSGSGSGTDFTLTISSLEPEDFAIYYCQQRSNWPPALTFGGGTKVEIK

SEQ ID NO: 517 - DNA, 330 bp, ARTIFICIAL
  Antibody
caagacatccagatgacccagtctccagccaccctgtctctgtctccaggggagagagccaccctctcctgcagggccagtcagagtgttagcaggtacttagcctggtatcaacaaaaacctggccaggctcccaggctcctcatctatgatacatccaacagggccactggcatcccagccaggttcagtggcagtgggtctgggacagacttcactctcaccatcagcagcctagagcctgaagattttgcaatttattactgtcagcagcgtagcaactggcctccggcgctcactttcggcggagggaccaaggtggagatcaaa

SEQ ID NO: 518 - protein, 120 aa, ARTIFICIAL
  Antibody
EVQLLESGGGLVQPGGSLRLSCAASGFTFSRYAMGWVRQAPGKGLEWVSWIYPSGGITSYADSVKGRFTISRDNSKNTLYLQMNSLRAEDTAMYYCARITYFDTSVIDYWGQGTLVTVSS

SEQ ID NO: 519 - DNA, 360 bp, ARTIFICIAL
  Antibody
gaagttcaattgttagagtctggtggcggtcttgttcagcctggtggttctttacgtctttcttgcgctgcttccggattcactttctctcgttacgctatgggttgggttcgccaagctcctggtaaaggtttggagtgggtttcttggatctatccttctggtggcattacttcttatgctgactccgttaaaggtcgcttcactatctctagagacaactctaagaatactctctacttgcagatgaacagcttaagggctgaggacaccgccatgtattactgtgcacggattacgtattttgataccagcgttattgactactggggccagggaaccctggtcaccgtctcaagc

SEQ ID NO: 520 - protein, 110 aa, ARTIFICIAL
  Antibody
QSVLTQPASVSGSPGQSITISCTGTSSNVGNYNLVSWYQQHPGKAPKLMIYEDNKRPSGVSNRFSVSKSGNTASLTISGLQTEDEAEYYCCSYAGSGTWCFGRRGTRVTV

SEQ ID NO: 521 - DNA, 330 bp, ARTIFICIAL
  Antibody
cagagcgtcttgactcagcctgcctccgtgtctgggtctcctggacagtcgatcaccatctcctgcactggaaccagcagtaatgttgggaattataaccttgtctcctggtaccagcagcacccaggcaaagcccccaaactcatgatttatgaggacaataagcggccctcaggggtttctaatcgcttctctgtgtccaagtctggcaacacggcctccctgacaatctctgggctccagactgaggacgaggctgaatattactgctgctcatatgcaggtagtggcacttggtgtttcgggcggaggggaaccagagtgaccgtc

SEQ ID NO: 522 - protein, 121 aa, ARTIFICIAL
  Antibody
EVQLLESGGGLVQPGGSLRLSCAASGFTFSHYPMEWVRQAPGKGLEWVSRIVPSGGWTTYADSVKGRFTISRDNSKNTLYLQMNSLRAEDTAVYYCASRVVTTYLDYFDYWGQGTLVTVSS

SEQ ID NO: 523 - DNA, 363 bp, ARTIFICIAL
  Antibody
gaagttcaattgttagagtctggtggcggtcttgttcagcctggtggttctttacgtctttcttgcgctgcttccggattcactttctctcattaccctatggagtgggttcgccaagctcctggtaaaggtttggagtgggtttctcgtatcgttccttctggtggctggactacttatgctgactccgttaaaggtcgcttcactatctctagagacaactctaagaatactctctacttgcagatgaacagcttaagggctgaggacacggccgtgtattactgtgcgagtcgggtggtaactacgtacttagactactttgactactggggccagggaaccctggtcaccgtctcaagc

SEQ ID NO: 524 - protein, 119 aa, ARTIFICIAL
  Antibody
EVQLLESGGGLVQPGGSLRLSCAASGFTFSVYVMSWVRQAPGKGLEWVSSIYPSGGGTYYADSVKGRFTISRDNSKNTLYLQMNSLRAEDTATYYCARRKAAAGYLDYWGQGTLVTVSS

SEQ ID NO: 525 - DNA, 357 bp, ARTIFICIAL
  Antibody
gaagttcaattgttagagtctggtggcggtcttgttcagcctggtggttctttacgtctttcttgcgctgcttccggattcactttctctgtttacgttatgtcttgggttcgccaagctcctggtaaaggtttggagtgggtttcttctatctatccttctggtggcggtacttattatgctgactccgttaaaggtcgcttcactatctctagagacaactctaagaatactctctacttgcagatgaacagcttaagggctgaggacacagccacatattactgtgcgagacgaaaagcagcagcaggttaccttgactactggggccagggaaccctggtcaccgtctcaagc

SEQ ID NO: 526 - protein, 110 aa, ARTIFICIAL
  Antibody
QSALTQPASVSGSPGQSITISCTGTSSDIGAYKHVSWYQQHPGKAPKLMIYEVTNRPSGISNRFSGSKSGNTASLTISGLQAEDEADYYCSSYTSRNTWVFGGGTKLTVL

SEQ ID NO: 527 - DNA, 330 bp, ARTIFICIAL
  Antibody
cagagcgctttgactcagcctgcctccgtgtctgggtctcctggacagtcgatcaccatttcctgcactggaactagcagtgacattggtgcttataaacatgtctcctggtatcaacaacacccaggcaaagcccccaaactcatgatttatgaggtcactaatcggccctcagggatttctaatcgtttctctggctccaagtctggcaacacggcctccctgaccatctctgggctccaggctgaggacgaggctgattattactgcagttcatatacaagccgtaacacttgggtatttggcggagggaccaagctgaccgtccta

SEQ ID NO: 528 - protein, 108 aa, ARTIFICIAL
  Antibody
QDIQMTQSPGTLSLSPGERATLSCRASQSVSSSYLAWYQQKPGQAPRLLIYDASSRATGIPDRFSGSGSGTDFTLTISRLEPEDFAVYYCQQYGRSPSFGPGTKVDIK

SEQ ID NO: 529 - DNA, 324 bp, ARTIFICIAL
  Antibody
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatgatgcatccagtagggccactggcatcccagacaggttcagtggcagtgggtctgggacagacttcactctcaccatcagcagactggagcctgaagattttgcagtgtattactgtcagcagtatggtaggtcaccctctttcggccctgggaccaaagtggatatcaaa

SEQ ID NO: 530 - protein, 117 aa, ARTIFICIAL
  Antibody
EVQLLESGGGLVQPGGSLRLSCAASGFTFSHYKMSWVRQAPGKGLEWVSSIYPSGGWTYYADSVKGRFTISRDNSKNTLYLQMNSLRAEDMAVYYCARDRPGAFDVWGQGTMVTVSS

SEQ ID NO: 531 - DNA, 351 bp, ARTIFICIAL
  Antibody
gaagttcaattgttagagtctggtggcggtcttgttcagcctggtggttctttacgtctttcttgcgctgcttccggattcactttctctcattacaagatgtcttgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacatggctgtgtattactgtgcaagagatcggcctggagcttttgatgtttggggccaagggacaatggtcaccgtctcaagc

SEQ ID NO: 532 - protein, 109 aa, ARTIFICIAL
  Antibody
QDIQMTQSPGTLSLSPGERATLSCRASQSVSSSYLAWYQQKPGQAPRLLIYGASSRATGIPDRFSGSGSGTDFTLTISRLEPDDSATYYCQQYNSYPITFGQGTRLEIK

SEQ ID NO: 533 - DNA, 327 bp, ARTIFICIAL
  Antibody
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgatgattctgcaacctattactgccaacaatataatagttatccgatcaccttcggccaagggacacgactggagattaaa

SEQ ID NO: 534 - protein, 119 aa, ARTIFICIAL
  Antibody
EVQLLESGGGLVQPGGSLRLSCAASGFTFSSYKMWWVRQAPGKGLEWVSVIYPSGGATYYADSVKGRFTISRDNSKNTLYLQMNSLRAEDTAVYYCARGIGAVGGFDSWGQGTLVTVSS

SEQ ID NO: 535 - DNA, 357 bp, ARTIFICIAL
  Antibody
gaagttcaattgttagagtctggtggcggtcttgttcagcctggtggttctttacgtctttcttgcgctgcttccggattcactttctcttcttacaagatgtggtgggttcgccaagctcctggtaaaggtttggagtgggtttctgttatctatccttctggtggcgctacttattatgctgactccgttaaaggtcgcttcactatctctagagacaactctaagaatactctctacttgcagatgaacagcttaagggctgaggacacggccgtgtattactgtgcgagagggatcggagcagtgggcgggtttgactcctggggccagggaaccctggtcaccgtctcaagc

SEQ ID NO: 536 - protein, 108 aa, ARTIFICIAL
  Antibody
QDIQMTQSPSSLSASVGDRVTIACRASHDISDNLNWYQQKPGRAPKVVISDAFNLEAGVPSRFSGSRSGTYFTFTINSLQPEDVATYYCQQFNNVPYTFGQGTKLEIK

SEQ ID NO: 537 - DNA, 324 bp, ARTIFICIAL
  Antibody
caagacatccagatgacccagtctccatcctccctgtctgcatctgtaggagacagagtcaccatcgcttgccgggcgagtcacgacattagtgacaatttaaattggtatcagcaaaaaccagggagagcccctaaggtcgtgatctccgatgcattcaatttggaagcaggggtcccatcaaggttcagtggaagtagatctgggacatattttactttcaccatcaacagcctgcagcctgaagatgttgcaacatattactgtcaacaatttaataatgtcccgtacacttttggccaggggaccaagctggagatcaaa

SEQ ID NO: 538 - protein, 119 aa, ARTIFICIAL
  Antibody
EVQLLESGGGLVQPGGSLRLSCAASGFTFSHYIMAWVRQAPGKGLEWVSRIYPSGGKTYYADSVKGRFTISRDNSKNTLYLQMNSLRAEDTAVYYCARQGGGGRAFDIWGQGTMVTVSS

SEQ ID NO: 539 - DNA, 357 bp, ARTIFICIAL
  Antibody
gaagttcaattgttagagtctggtggcggtcttgttcagcctggtggttctttacgtctttcttgcgctgcttccggattcactttctctcattacattatggcttgggttcgccaagctcctggtaaaggtttggagtgggtttctcgtatctatccttctggtggcaagacttattatgctgactccgttaaaggtcgcttcactatctctagagacaactctaagaatactctctacttgcagatgaacagcttaagggctgaggacacggccgtgtattactgtgcgagacagggtggtggtgggcgtgcttttgatatctggggccaagggacaatggtcaccgtctcaagc

SEQ ID NO: 540 - protein, 108 aa, ARTIFICIAL
  Antibody
QSALTQDPAVSVALGQTVKITCQGDSLRNYYASWYQQKPGQAPIVVIYGKNNRPSGIPDRFSGSRSGSTASLTITGAQAVDEADYYCSSRDTTNYRMEFGGGTKLTVL

SEQ ID NO: 541 - DNA, 324 bp, ARTIFICIAL
  Antibody
cagagcgctttgactcaggaccctgctgtgtctgtggccttgggacagacagtcaagatcacatgccaaggagacagtctcagaaattattatgcaagctggtaccagcagaagccaggacaggcccctatagttgtcatctatggtaaaaacaaccggccctcagggatcccagaccgtttctctggctccaggtcaggaagcacagcttccttgaccatcactggggctcaggcggtagatgaggctgactattactgtagttcccgggacactactaattaccgcatggaattcggcggagggaccaagctgactgtccta

SEQ ID NO: 542 - protein, 119 aa, ARTIFICIAL
  Antibody
EVQLLESGGGLVQPGGSLRLSCAASGFTFSSYIMAWVRQAPGKGLEWVSGIYPSGGFTTYADSVKGRFTISRDNSKNTLYLQMNSLRAEDTAVYYCAKIAGGAYHLDYWGQGTLVTVSS

SEQ ID NO: 543 - DNA, 357 bp, ARTIFICIAL
  Antibody
gaagttcaattgttagagtctggtggcggtcttgttcagcctggtggttctttacgtctttcttgcgctgcttccggattcactttctcttcttacattatggcttgggttcgccaagctcctggtaaaggtttggagtgggtttctggtatctatccttctggtggctttactacttatgctgactccgttaaaggtcgcttcactatctctagagacaactctaagaatactctctacttgcagatgaacagcttaagggctgaggacacggctgtgtattactgtgcgaaaattgcagggggagcctaccaccttgattactggggccagggaaccctggtcaccgtctcaagc

SEQ ID NO: 544 - protein, 110 aa, ARTIFICIAL
  Antibody
QDIQMIQSPATLSLSPGERATLSCRASQSVSSYLAWYQQKPGQAPRLLIYDASNRATGIPARFSGSGSGTDFTLTISSLEPEDFAVYYCQQRSNWPPALTFGGGTKVEIK

SEQ ID NO: 545 - DNA, 330 bp, ARTIFICIAL
  Antibody
caagacatccagatgatccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccggccctcactttcggcggagggaccaaggtggagatcaaa

SEQ ID NO: 546 - protein, 118 aa, ARTIFICIAL
  Antibody
EVQLLESGGGLVQPGGSLRLSCAASGFTFSRYGMEWVRQAPGKGLEWVSSIYPSGGWTYYADSVKGRFTISRDNSKNTLYLQMNSLRAEDTAVYYCARRGSGRYFDYWGQGTLVTVSS

SEQ ID NO: 547 - DNA, 354 bp, ARTIFICIAL
  Antibody
gaagttcaattgttagagtctggtggcggtcttgttcagcctggtggttctttacgtctttcttgcgctgcttccggattcactttctctcgttacggtatggagtgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacacggccgtgtattactgtgcgagacggggtagtggccggtactttgactactggggccagggcaccctggtcaccgtctcaagc

SEQ ID NO: 548 - protein, 110 aa, ARTIFICIAL
  Antibody
QSELTQPPSASGSPGQSVTITCTGTSSDVGYYNYVSWYQQHPGKAPKLMIFEVSNRPSGVPDRFSGSKSGNTASLTVSGLQAEDEAHYYCSSYAGSDNFVFGSGTKVTVL

SEQ ID NO: 549 - DNA, 330 bp, ARTIFICIAL
  Antibody
cagagcgaattgactcagcctccctccgcgtccgggtctcctggacagtcagtcaccatcacctgcactggaaccagcagtgacgttggttattataactatgtctcctggtatcaacaacacccaggcaaagcccccaaactcatgatttttgaggtcagtaatcggccctcaggggtccctgatcgcttctctggctccaagtctggcaacacggcctccctgaccgtctctgggctccaggctgaggatgaggctcattattactgcagctcatatgcaggcagcgacaattttgtcttcggaagtgggaccaaggtcaccgtctta

SEQ ID NO: 550 - protein, 119 aa, ARTIFICIAL
  Antibody
EVQLLESGGGLVQPGGSLRLSCAASGFTFSIYVMGWVRQAPGKGLEWVSSIYPSGGYTWYADSVKGRFTISRDNSKNTLYLQMNSLRAEDTAVYYCARQGGGGRAFDIWGQGTTVTVSS

SEQ ID NO: 551 - DNA, 357 bp, ARTIFICIAL
  Antibody
gaagttcaattgttagagtctggtggcggtcttgttcagcctggtggttctttacgtctttcttgcgctgcttccggattcactttctctatttacgttatgggttgggttcgccaagctcctggtaaaggtttggagtgggtttcttctatctatccttctggtggctatacttggtatgctgactccgttaaaggtcgcttcactatctctagagacaactctaagaatactctctacttgcagatgaacagcttaagggctgaggacacggccgtgtattactgtgcgagacagggaggaggcggtcgtgcttttgatatctggggccaagggaccacggtcaccgtctcaagc

SEQ ID NO: 552 - protein, 112 aa, ARTIFICIAL
  Antibody
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLFYVFGTGTKVTVL

SEQ ID NO: 553 - DNA, 336 bp, ARTIFICIAL
  Antibody
cagagcgtcttgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcttttatgtcttcggaactgggaccaaggtcaccgtccta

SEQ ID NO: 554 - protein, 129 aa, ARTIFICIAL
  Antibody
EVQLLESGGGLVQPGGSLRLSCAASGFTFSRYKMMWVRQAPGKGLEWVSYIVPSGGWTYYADSVKGRFTISRDNSKNTLYLQMNSLRAEDTAVYYCARVDYYDFWSGYWWSGGYGMDVWGQGTTVTVSS

SEQ ID NO: 555 - DNA, 387 bp, ARTIFICIAL
  Antibody
gaagttcaattgttagagtctggtggcggtcttgttcagcctggtggttctttacgtctttcttgcgctgcttccggattcactttctctcgttacaagatgatgtgggttcgccaagctcctggtaaaggtttggagtgggtttcttatatcgttccttctggtggctggacttattatgctgactccgttaaaggtcgcttcactatctctagagacaactctaagaatactctctacttgcagatgaacagcttaagggctgaggacacggccgtgtattactgtgcgagagttgactattacgatttttggagtggttattggtggtcgggggggtacggtatggacgtctggggccaagggaccacggtcaccgtctcaagc

SEQ ID NO: 556 - protein, 108 aa, ARTIFICIAL
  Antibody
QDIQMTQSPSFLSASVGDRVTITCRASQGISTYLAWYQQKPGKAPKLLIYATSTLQSGVPSRFSGSGSGTEFTLAISTLQPEDFATYYCQQLNSYPITFGQGTRLEIK

SEQ ID NO: 557 - DNA, 324 bp, ARTIFICIAL
  Antibody
caagacatccagatgacccagtctccatccttcctgtctgcatctgtaggagacagagtcaccatcacttgccgggccagtcagggcataagcacttatttagcctggtatcagcaaaagccagggaaagcccctaagctcttgatctatgctacatccactttgcaaagtggagtcccatcaaggttcagcggcagtgggtctgggacagaattcactctcgcaatcagcaccctgcagcctgaagattttgcaacttattactgtcaacaactcaatagttacccgatcactttcggccaagggacgcgactggagattaaa

SEQ ID NO: 558 - protein, 117 aa, ARTIFICIAL; identical to SEQ ID NO: 390
  Antibody

SEQ ID NO: 559 - DNA, 351 bp, ARTIFICIAL; identical to SEQ ID NO: 391
  Antibody

SEQ ID NO: 560 - protein, 108 aa, ARTIFICIAL
  Antibody
QNIQMTQSPATLSLSPGERATLSCRASQSISSYLAWYQQKPGQVPRLLIYDASNRATGIPARFSGSGSGTDFTLTISRLEPEDFAVYYCQQYGSLPRTFGQGTKVEIK

SEQ ID NO: 561 - DNA, 324 bp, ARTIFICIAL
  Antibody
caaaacatccagatgacccagtctccagccaccctgtctttgtctccaggggagagagccaccctctcctgcagggccagtcagagtattagcagttacttagcctggtatcaacagaaacctggccaggttcccaggctcctcatctatgatgcatccaatagggccactggcatcccagccaggttcagtggcagtgggtctgggacagacttcactctcaccatcagcagactggagcctgaagattttgcagtttattactgtcagcagtatggtagtttacctcggacgttcggccaagggaccaaggtggaaatcaaa

SEQ ID NO: 562 - protein, 119 aa, ARTIFICIAL
  Antibody
EVQLLESGGGLVQPGGSLRLSCAASGFTFSKYKMHWVRQAPGKGLEWVSVIYPSGGKTYYADSVKGRFTISRDNSKNTLYLQMNSLRAEDTAVYYCAREMGGSGWYDYWGQGTLVTVSS

SEQ ID NO: 563 - DNA, 357 bp, ARTIFICIAL
  Antibody
gaagttcaattgttagagtctggtggcggtcttgttcagcctggtggttctttacgtctttcttgcgctgcttccggattcactttctctaagtacaagatgcattgggttcgccaagctcctggtaaaggtttggagtgggtttctgttatctatccatctggtggcaagacttattatgctgactccgttaaaggtcgcttcactatctctagagacaactctaagaatactctctacttgcagatgaacagcttaagggctgaggacacggccgtgtattactgtgcgagagaaatgggtggtagtggctggtacgactactggggccagggaaccctggtcaccgtctcaagc

SEQ ID NO: 564 - protein, 108 aa, ARTIFICIAL
  Antibody
QDIQMTQSPATLSLSPGARATLSCRASQSVSSYLAWYQQRPGQTPRLLIYGASSRATGIPDRFSGSGSGTDFTLTISRLEPEDFAVYYCQQYGSSRHTFGQGTKLEIK

SEQ ID NO: 565 - DNA, 324 bp, ARTIFICIAL
  Antibody
caagacatccagatgacccagtctccagccaccctgtctttgtctccaggggcaagagccaccctctcctgcagggccagtcagagtgttagcagctacttagcctggtaccaacagagacctggccagactcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacgacacacttttggccaggggaccaagctggagatcaaa

SEQ ID NO: 566 - protein, 119 aa, ARTIFICIAL
  Antibody
EVQLLESGGGLVQPGGSLRLSCAASGFTFSQYVMRWVRQAPGKGLEWVSGIYPSGGWTTYADSVKGRFTISRDNSKNTLYLQMNSLRAEDTAVYYCATVAAAAGAFDIWGQGTMVTVSS

SEQ ID NO: 567 - DNA, 357 bp, ARTIFICIAL
  Antibody
gaagttcaattgttagagtctggtggcggtcttgttcagcctggtggttctttacgtctttcttgcgctgcttccggattcactttctctcagtacgttatgcgttgggttcgccaagctcctggtaaaggtttggagtgggtttctggtatctatccttctggtggctggactacttatgctgactccgttaaaggtcgcttcactatctctagagacaactctaagaatactctctacttgcagatgaacagcttaagggctgaggacacggccgtgtattactgtgcaacagtggcagcagctgcgggggcttttgatatctggggccaagggacaatggtcaccgtctcaagc

SEQ ID NO: 568 - protein, 109 aa, ARTIFICIAL
  Antibody
QDIQMTQSPGTLSLSPGERATLSCRASQSISSSYLAWYQQKPGQAPRLLLYGTSNRATGIPDRFSGSGSGTDFTLTISRLEPEDFALYYCQQRYKWPLTFGPGTKVDFK

SEQ ID NO: 569 - DNA, 327 bp, ARTIFICIAL
  Antibody
caagacatccagatgacccagtctccaggcaccctgtctttgtctccaggggaaagagccaccctctcctgcagggccagtcagagtattagcagcagctacttagcctggtaccagcagaaacctggccaggctccccggctcctcctctatggtacatccaacagggccactggcatcccagacaggttcagtggcagtgggtctgggacagacttcactctcaccatcagcagactggagcctgaagactttgcactttattactgtcagcagcgttacaagtggcctctcactttcggccctgggaccaaggtggatttcaaa

SEQ ID NO: 570 - protein, 119 aa, ARTIFICIAL
  Antibody
EVQLLESGGGLVQPGGSLRLSCAASGFTFSHYGMWWVRQAPGKGLEWVSVISPSGGQTNYADSVKGRFTISRDNSKNTLYLQMNSLRAEDTAVYYCAKGQIHGGNLASWGQGTLVTVSS

SEQ ID NO: 571 - DNA, 357 bp, ARTIFICIAL
  Antibody
gaagttcaattgttagagtctggtggcggtcttgttcagcctggtggttctttacgtctttcttgcgctgcttccggattcactttctctcattacggtatgtggtgggttcgccaagctcctggtaaaggtttggagtgggtttctgttatctctccttctggtggccagactaattatgctgactccgttaaaggtcgcttcactatctctagagacaactctaagaatactctctacttgcagatgaacagcttaagggctgaggacactgccgtgtattactgtgccaaagggcaaatccacggtggtaatcttgcctcctggggccagggaaccctggtcaccgtctcaagc

SEQ ID NO: 572 - protein, 111 aa, ARTIFICIAL
  Antibody
QSALTQPASVSGSPGQSITISCTGTSSDVGGYNYVSWYQQHPGKAPKLMISDVSNRPSGVSNRFSGSKSGNTASLTISGLQAEDEADYYCSSYTSSSTLYVFGTGTKVTVL

SEQ ID NO: 573 - DNA, 333 bp, ARTIFICIAL
  Antibody
cagagcgctttgactcagcctgcctccgtgtctgggtctcctggacagtcgatcaccatctcctgcactggaactagcagcgacgttggtggttataactatgtctcctggtaccaacagcacccaggcaaagcccccaaactcatgatttctgatgtcagtaatcggccctcaggggtttctaatcgcttctctggctccaagtctggcaacacggcctccctgaccatctctgggctccaggctgaggacgaggctgattattactgcagctcatatacaagcagcagcactctgtatgtcttcggaactgggaccaaggtcaccgtccta

SEQ ID NO: 574 - protein, 122 aa, ARTIFICIAL
  Antibody
EVQLLESGGGLVQPGGSLRLSCAASGFTFSNYKMNWVRQAPGKGLEWVSVIYPSGGATYYADSVKGRFTISRDNSKNTLYLQMNSLRAEDTAMYYCARVGYSSSWDPHFDYWGQGTLVTVSS

SEQ ID NO: 575 - DNA, 366 bp, ARTIFICIAL
  Antibody
gaagttcaattgttagagtctggtggcggtcttgttcagcctggtggttctttacgtctttcttgcgctgcttccggattcactttctctaattacaagatgaattgggttcgccaagctcctggtaaaggtttggagtgggtttctgttatctatccttctggtggcgctacttattatgctgactccgttaaaggtcgcttcactatctctagagacaactctaagaatactctctacttgcagatgaacagcttaagggctgaggacaccgccatgtattactgtgcgagagtcgggtatagcagcagctgggacccccactttgactactggggccagggaaccctggtcaccgtctcaagc

SEQ ID NO: 576 - protein, 109 aa, ARTIFICIAL
  Antibody
QDIQMTQSPATLSLSPGERATLSCRASQSVSSSYLAWYQQKPGQAPRLLIYGASSRATGIPDRFSGSGSGTEFTLTISSLQSEDFGVYYCQQYKDWPRTFGQGTKVEIK

SEQ ID NO: 577 - DNA, 327 bp, ARTIFICIAL
  Antibody
caagacatccagatgacccagtctccagccaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagagttcactctcaccatcagcagcctgcagtctgaagattttggagtttattattgtcagcagtataaggactggcctcgaacgttcggccaagggaccaaggtggaaatcaaa

SEQ ID NO: 578 - protein, 128 aa, ARTIFICIAL
  Antibody
EVQLLESGGGLVQPGGSLRLSCAASGFTFSSYRMVWVRQAPGKGLEWVSSIYPSGGPTRYADSVKGRFTISRDNSKNTLYLQMNSLRAEDTAVYYCARWSYYYDSSGYYPVSGPFDIWGQGTMVTVSS

SEQ ID NO: 579 - DNA, 384 bp, ARTIFICIAL
  Antibody
gaagttcaattgttagagtctggtggcggtcttgttcagcctggtggttctttacgtctttcttgcgctgcttccggattcactttctcttcttaccgtatggtttgggttcgccaagctcctggtaaaggtttggagtgggtttcttctatctatccttctggtggccctactcgttatgctgactccgttaaaggtcgcttcactatctctagagacaactctaagaatactctctacttgcagatgaacagcttaagggctgaggacacggccgtgtattactgtgcgagatggtcgtattactatgatagtagtggttattaccccgtgagtgggccttttgatatctggggccaagggacaatggtcaccgtctcaagc

SEQ ID NO: 580 - protein, 110 aa, ARTIFICIAL
  Antibody
QDIQMTQSPGTLSLSPGERATLSCRASQGVRSTYLAWYQQKPGQAPRLLIYGASSRATGIPDRFSGSGSGTDFTLTISRLEPEDFAVYYCQQYGSSQGFTFGPGTKVDIK

SEQ ID NO: 581 - DNA, 330 bp, ARTIFICIAL
  Antibody
caagacatccagatgacccagtctccaggcaccctgtctttgtctccaggggaaagagccaccctctcctgcagggccagtcagggtgttagaagtacctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacagggtttcactttcggccctgggaccaaagtggatatcaaa

SEQ ID NO: 582 - protein, 117 aa, ARTIFICIAL
  Antibody
EVQLLESGGGLVQPGGSLRLSCAASGFTFSMYKMHWVRQAPGKGLEWVSVIYPSGGITAYADSVKGRFTISRDNSKNTLYLQMNSLRADDTAVYYCTREVMGPSDYWGQGTLVTVSS

SEQ ID NO: 583 - DNA, 351 bp, ARTIFICIAL
  Antibody
gaagttcaattgttagagtctggtggcggtcttgttcagcctggtggttctttacgtctttcttgcgctgcttccggattcactttctctatgtacaagatgcattgggttcgccaagctcctggtaaaggtttggagtgggtttctgttatctatccttctggtggcattactgcttatgctgactccgttaaaggtcgcttcactatctctagagacaactctaagaatactctctacttgcagatgaacagcttaagggctgatgacacagccgtgtattactgtactagagaggttatgggaccatctgactactggggccagggaaccctggtcaccgtctcaagc

SEQ ID NO: 584 - protein, 108 aa, ARTIFICIAL
  Antibody
QDIQMTQSPATLSVSPGERATLSCRSSQSLSNNLAWYQQKPGQAPRLLIYGASTRATGIPARFSGSGSGTEFTLTISSLQSEDFATYYCQQANSFPRTFGQGTKLEIK

SEQ ID NO: 585 - DNA, 324 bp, ARTIFICIAL
  Antibody
caagacatccagatgacccagtctccagccaccctgtctgtgtctccaggggaaagagccaccctctcctgcaggtccagtcagagtcttagcaacaacttagcctggtaccagcagaaacctggccaggctcccaggctcctcatctatggtgcatccaccagggccactggcatcccagccaggttcagtggcagtgggtctgggacagagttcactctcaccatcagcagcctgcagtctgaagattttgcaacttactattgtcaacaggctaacagtttccctcgaacttttggccaggggaccaagctggagatcaaa

SEQ ID NO: 586 - protein, 120 aa, ARTIFICIAL
  Antibody
EVQLLESGGGLVQPGGSLRLSCAASGFTFSKYVMHWVRQAPGKGLEWVSSIYPSGGWTYYADSVKGRFTISRDNSKNTLYLQMNSLRAEDTAVYYCATSTTYSSRPFDYWGQGTLVTVSS

SEQ ID NO: 587 - DNA, 360 bp, ARTIFICIAL
  Antibody
gaagttcaattgttagagtctggtggcggtcttgttcagcctggtggttctttacgtctttcttgcgctgcttccggattcactttctctaagtacgttatgcattgggttcgccaagctcctggtaaaggtttggagtgggtttcttctatctatccttctggtggctggacttattatgctgactccgttaaaggtcgcttcactatctctagagacaactctaagaatactctctacttgcagatgaacagcttaagggctgaggacacggccgtgtattactgtgcgacctctacgacttatagcagcaggccctttgactattggggccagggaaccctggtcaccgtctcaagc

SEQ ID NO: 588 - protein, 109 aa, ARTIFICIAL
  Antibody
QDIQMTQSPSSLSASVGDRVAITCRASQSIDTYLNWYQHKPGKAPKLLIYAASKLEDGVPSRFSGSGTGTDFTLTIRSLQPEDFASYFCQQSYSSPGITFGPGTKVEIK

SEQ ID NO: 589 - DNA, 327 bp, ARTIFICIAL
  Antibody
caagacatccagatgacccagtctccatcctccctgtctgcatctgtgggagacagagtcgccatcacttgccgcgcaagtcagagcatcgacacctatttaaattggtatcagcacaaaccagggaaagcccctaaactcctgatctatgctgcatccaagttggaagacggggtcccatcaagattcagtggcagtggaactgggacagatttcactctcaccatcagaagtctgcaacctgaagattttgcaagttatttctgtcaacagagctactctagtccagggatcactttcggccctgggaccaaggtggagatcaaa

SEQ ID NO: 590 - protein, 120 aa, ARTIFICIAL
  Antibody
EVQLLESGGGLVQPGGSLRLSCAASGFTFSRYPMMWVRQAPGKGLEWVSVIYSSGGYTYYADSVKGRFTISRDNSKNTLYLQMNSLRAEDTAVYYCARVSRGIYYAMDVWGQGTTVTVSS

SEQ ID NO: 591 - DNA, 360 bp, ARTIFICIAL
  Antibody
gaagttcaattgttagagtctggtggcggtcttgttcagcctggtggttctttacgtctttcttgcgctgcttccggattcactttctctcgttaccctatgatgtgggttcgccaagctcctggtaaaggtttggagtgggtttctgttatctattcttctggtggctatacttattatgctgactccgttaaaggtcgcttcactatctctagagacaactctaagaatactctctacttgcagatgaacagcttaagggctgaggacacggccgtgtattactgtgcgagagtatctcgcgggatctactacgctatggacgtctggggccaagggaccacggtcaccgtctcaagc

SEQ ID NO: 592 - protein, 109 aa, ARTIFICIAL
  Antibody
QDIQMTQSPGTLSLSPGERATLSCRASQSVSSSYLAWYQQKPGQAPRLLIYGASSRATGIPDRFSGSGSGTDFTLTISRLEPEDFVVYYCQQYGRSRYTFGQGTKLEIK

SEQ ID NO: 593 - DNA, 327 bp, ARTIFICIAL
  Antibody
caagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgtagtgtattactgtcagcagtatggtaggtcacggtacacttttggccaggggaccaagctggagatcaaa

SEQ ID NO: 594 - protein, 124 aa, ARTIFICIAL
  Antibody
EVQLLESGGGLVQPGGSLRLSCAASGFTFSNYKMHWVRQAPGKGLEWVSSIYPSGGPTHYADSVKGRFTISRDNSKNTLYLQMNSLRAEDTAVYYCAREGYSSGWYIHWYFDLWGRGTLVTVSS

SEQ ID NO: 595 - DNA, 372 bp, ARTIFICIAL
  Antibody
gaagttcaattgttagagtctggtggcggtcttgttcagcctggtggttctttacgtctttcttgcgctgcttccggattcactttctctaattacaagatgcattgggttcgccaagctcctggtaaaggtttggagtgggtttcttctatctatccttctggtggccctactcattatgctgactccgttaaaggtcgcttcactatctctagagacaactctaagaatactctctacttgcagatgaacagcttaagggctgaggacacggccgtgtattactgtgcgagagaagggtatagcagtggctggtacattcactggtacttcgatctctggggccgtggcaccctggtcaccgtctcaagc

SEQ ID NO: 596 - protein, 108 aa, ARTIFICIAL
  Antibody
QDIQMTQSPSSLSASVGDRVAITCRASQSIDTYLNWYQQKPGKAPKLLIYDASNLETGVPSRFSGSGSGTHFTFTISSLQPEDFATYYCQQADSFPITFGQGTRLEIK

SEQ ID NO: 597 - DNA, 324 bp, ARTIFICIAL
  Antibody
caagacatccagatgacccagtctccatcctccctgtctgcatctgtgggagacagagtcgccatcacttgccgcgcaagtcagagcatcgacacctatttaaattggtatcagcagaaaccagggaaagcccctaagctcctgatctacgatgcatccaatttggaaacaggggtcccatcaaggttcagtggaagtggatctgggacacactttaccttcaccatcagcagcctgcagcctgaagattttgcaacttactattgtcagcaggctgacagtttcccgatcaccttcggccaagggacacgactggagattaaa

SEQ ID NO: 598 - protein, 120 aa, ARTIFICIAL
  Antibody
EVQLLESGGGLVQPGGSLRLSCAASGFTFSSYFMTWVRQAPGKGLEWVSGISPSGGITSYADSVKGRFTISRDNSKNTLYLQMNSLRAEDTAVYYCAKGSYSDYGVFNSWGQGTLVTVSS

SEQ ID NO: 599 - DNA, 360 bp, ARTIFICIAL
  Antibody
gaagttcaattgttagagtctggtggcggtcttgttcagcctggtggttctttacgtctttcttgcgctgcttccggattcactttctcttcttactttatgacttgggttcgccaagctcctggtaaaggtttggagtgggtttctggtatctctccttctggtggcattacttcttatgctgactccgttaaaggtcgcttcactatctctagagacaactctaagaatactctctacttgcagatgaacagcttaagggctgaggacacggccgtgtattactgtgcgaaaggctcatacagtgattacggggtctttaattcctggggccagggaaccctggtcaccgtctcaagc

SEQ ID NO: 600 - protein, 108 aa, ARTIFICIAL
  Antibody
QDIQMTQSPATLSVSPGERATLSCRASQSISSSLAWYQQKPGQAPRLLIYDASNRATGIPARFSGSGSGTDFTLTISSLEPEDFAVYYCQQRSNWPLTFGGGTKVEIK

SEQ ID NO: 601 - DNA, 324 bp, ARTIFICIAL
  Antibody
caagacatccagatgacccagtctccagccaccctgtctgtgtctccaggggaaagagccaccctctcctgcagggccagtcagagtattagcagcagcttagcctggtaccagcagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgctcactttcggcggagggaccaaggtggagatcaaa

SEQ ID NO: 602 - protein, 117 aa, ARTIFICIAL
  Antibody
EVQLLESGGGLVQPGGSLRLSCAASGFTFSNYVMAWVRQAPGKGLEWVSVIYPSGGATYYADSVKGRFTISRDNSKNTLYLQMNSLRAEDTAVYYCTRLAVTHFDYWGQGTLVTVSS

SEQ ID NO: 603 - DNA, 351 bp, ARTIFICIAL
  Antibody
gaagttcaattgttagagtctggtggcggtcttgttcagcctggtggttctttacgtctttcttgcgctgcttccggattcactttctctaattacgttatggcttgggttcgccaagctcctggtaaaggtttggagtgggtttctgttatctatccttctggtggcgctacttattatgctgactccgttaaaggtcgcttcactatctctagagacaactctaagaatactctctacttgcagatgaacagcttaagggctgaggacacggccgtgtattactgtacgagactggcggttactcactttgactactggggccagggaaccctggtcaccgtctcaagc

SEQ ID NO: 604 - protein, 108 aa, ARTIFICIAL
  Antibody
QDIQMTQSPSTLSASVGDRVTITCRASQGISNYLAWYQQKPGKVPKLLIYGASNLQSGVSSRFSGSGSATDFTLTISSLQPEDFATYYCQQFNSYPLTFGGGTKVEIK

SEQ ID NO: 605 - DNA, 324 bp, ARTIFICIAL
  Antibody
caagacatccagatgacccagtctccttccaccctgtctgcatctgtaggagacagagtcaccatcacttgccgggcgagtcagggcattagcaattatttagcctggtatcaacagaaaccagggaaagttcctaaactcctgatctatggtgcatctaatttgcagtcaggggtctcatcgcggttcagtggcagtggatctgcgacagatttcaccctcaccatcagcagcctgcagcctgaagattttgcaacttattactgtcaacagtttaatagttaccctctgactttcggcggagggaccaaggtggagatcaaa

SEQ ID NO: 606 - protein, 118 aa, ARTIFICIAL
  Antibody
EVQLLESGGGLVQPGGSLRLSCAASGFTFSDYGMAWVRQAPGKGLEWVSVISPSGGQTAYADSVKGRFTISRDNSKNTLYLQMNSLRAEDTAVYYCATVRWFGAFDYWGQGTLVTVSS

SEQ ID NO: 607 - DNA, 354 bp, ARTIFICIAL
  Antibody
gaagttcaattgttagagtctggtggcggtcttgttcagcctggtggttctttacgtctttcttgcgctgcttccggattcactttctctgattacggtatggcttgggttcgccaagctcctggtaaaggtttggagtgggtttctgttatctctccttctggtggccagactgcttatgctgactccgttaaaggtcgcttcactatctctagagacaactctaagaatactctctacttgcagatgaacagcttaagggctgaggacacggctgtgtattactgtgccacagttagatggttcggggcatttgactactggggccagggaaccctggtcaccgtctcaagc

SEQ ID NO: 608 - protein, 111 aa, ARTIFICIAL
  Antibody
QDIQMTQSPGTLSLSPGERATLSCRASQSVTSSFLSWYQHRPGQAPRLLIYATSTRATGIPDRFSGSGSGTDFTLTISRLEPEDFAVYYCQHYHTSPPTYTFGQGTKLEIK

SEQ ID NO: 609 - DNA, 333 bp, ARTIFICIAL
  Antibody
caagacatccagatgacccagtctccaggcacgctgtctttgtctccaggggaaagagccaccctctcctgcagggccagtcaaagtgtgaccagcagcttcttatcctggtaccagcacagacctggccaggctcccaggctcctcatctatgctacatccaccagggccacaggcatcccagacaggttcagtggcagtgggtctgggacagacttcactctcactatcagcagactggagcctgaagattttgcagtgtattactgtcagcactatcatacctcacctcccacttacacttttggccaggggaccaagctggagatcaaa

SEQ ID NO: 610 - protein, 117 aa, ARTIFICIAL
  Antibody
EVQLLESGGGLVQPGGSLRLSCAASGFTFSLYLMYWVRQAPGKGLEWVSVIYPSGGWTYYADSVKGRFTISRDNSKNTLYLQMNSLRAEDTAMYYCARGYYYGMDVWGQGTTVTVSS

SEQ ID NO: 611 - DNA, 351 bp, ARTIFICIAL
  Antibody
gaagttcaattgttagagtctggtggcggtcttgttcagcctggtggttctttacgtctttcttgcgctgcttccggattcactttctctctttaccttatgtattgggttcgccaagctcctggtaaaggtttggagtgggtttctgttatctatccttctggtggctggacttattatgctgactccgttaaaggtcgcttcactatctctagagacaactctaagaatactctctacttgcagatgaacagcttaagggctgaggacaccgccatgtattactgtgcgagaggctactactacggtatggacgtctggggccaagggaccacggtcaccgtctcaagc

SEQ ID NO: 612 - protein, 110 aa, ARTIFICIAL
  Antibody
QSALTQPPSVSVAPGETAEITCGGENIGSKSVHWYQQKPGQAPVLVIYYDNDRPSGIPERFSGSNFGSTATLTISRVEAGDEADYYCQVWDSGSEHYVFGTETKVTVLGQ

SEQ ID NO: 613 - DNA, 330 bp, ARTIFICIAL
  Antibody
cagagcgctttgactcagccaccctcagtctcagtggccccaggggagacggccgaaattacctgtgggggcgagaacattggaagtaaaagtgtccattggtaccagcagaagccaggccaggccccagtgctggtcatctattatgataacgaccgcccctcagggatccctgagcgattctctggctccaactttgggagcacggccaccctgaccatcagcagggtcgaagccggggatgaggccgactattactgtcaggtctgggatagtggcagtgagcactatgtcttcggaactgagaccaaggtcaccgtcctaggtcag

SEQ ID NO: 614 - protein, 116 aa, ARTIFICIAL
  Antibody
EVQLLESGGGLVQPGGSLRLSCAASGFTFSGYIMMWVRQAPGKGLEWVSSIYPSGGHTYYADSVKGRFTISRDNSKNTLYLQMNSLRAEDTAVYYCARWYYGMDVWGQGTTVTVSS

SEQ ID NO: 615 - DNA, 348 bp, ARTIFICIAL
  Antibody
gaagttcaattgttagagtctggtggcggtcttgttcagcctggtggttctttacgtctttcttgcgctgcttccggattcactttctctggttacattatgatgtgggttcgccaagctcctggtaaaggtttggagtgggtttcttctatctatccttctggtggccatacttattatgctgactccgttaaaggtcgcttcactatctctagagacaactctaagaatactctctacttgcagatgaacagcttaagggctgaggacacggccgtgtattactgtgcgagatggtattacggtatggacgtctggggccaagggaccacggtcaccgtctcaagc

SEQ ID NO: 616 - protein, 109 aa, ARTIFICIAL
  Antibody
QSALTQPASVSGSPGQSITISCTGTNSDVGGYNYVSWYQQHPGKAPKLIIFDVTNRPSGVSNRFSGSKAGNTASLTISGLQAEDEADYYCSSYSSTSPRFGGGTKLTVL

SEQ ID NO: 617 - DNA, 327 bp, ARTIFICIAL
  Antibody
cagagcgctttgactcagcctgcctccgtgtcagggtctcctggacagtcgatcaccatttcctgcactggaaccaacagtgacgttggtggttataactatgtctcctggtaccaacagcacccaggcaaagcccccaaactcataatttttgatgtcactaatcggccctcaggggtttctaatcgcttctctggctccaaggctggcaacacggcctccctgaccatctctgggctccaggctgaggacgaggctgattattactgcagctcatattcaagtaccagccctcgcttcggcggagggaccaagctgaccgtcctg

SEQ ID NO: 618 - protein, 120 aa, ARTIFICIAL
  Antibody
EVQLLESGGGLVQPGGSLRLSCAASGFTFSMYQMQWVRQAPGKGLEWVSRIYPSGGWTVYADSVKGRFTISRDNSKNTLYLQMNSLRAEDTAVYYCTRITYDSSGYYDYWGQGTLVTVSS

SEQ ID NO: 619 - DNA, 360 bp, ARTIFICIAL
  Antibody
gaagttcaattgttagagtctggtggcggtcttgttcagcctggtggttctttacgtctttcttgcgctgcttccggattcactttctctatgtaccagatgcagtgggttcgccaagctcctggtaaaggtttggagtgggtttctcgtatctatccttctggtggctggactgtttatgctgactccgttaaaggtcgcttcactatctctagagacaactctaagaatactctctacttgcagatgaacagcttaagggctgaggacacagccgtgtattactgtacacggatcacgtatgatagtagtggttattacgactactggggccagggaaccctggtcaccgtctcaagc

SEQ ID NO: 620 - protein, 109 aa, ARTIFICIAL; identical to SEQ ID NO: 588
  Antibody

SEQ ID NO: 621 - DNA, 327 bp, ARTIFICIAL; identical to SEQ ID NO: 589
  Antibody

SEQ ID NO: 622 - protein, 121 aa, ARTIFICIAL
  Antibody
EVQLLESGGGLVQPGGSLRLSCAASGFTFSPYKMIWVRQAPGKGLEWVSGIYPSGGWTYYADSVKGRFTISRDNSKNTLYLQMNSLRAEDTAMYYCARLLPALRGAVMDVWGQGTTVTVSS

SEQ ID NO: 623 - DNA, 363 bp, ARTIFICIAL
  Antibody
gaagttcaattgttagagtctggtggcggtcttgttcagcctggtggttctttacgtctttcttgcgctgcttccggattcactttctctccttacaagatgatttgggttcgccaagctcctggtaaaggtttggagtgggtttctggtatctatccttctggtggctggacttattatgctgactccgttaaaggtcgcttcactatctctagagacaactctaagaatactctctacttgcagatgaacagcttaagggctgaggacaccgccatgtattactgtgcgagactgttaccagccttgcggggagccgtgatggacgtctggggccaagggaccacggtcaccgtctcaagc

SEQ ID NO: 624 - protein, 107 aa, ARTIFICIAL
  Antibody
QSVLTQDPTVSVALGQTVRITCRGDRLRSYYSSWYQQKPRQAPVLVMFGRNNRPSGIPDRFSGSTSGSTASLTITATQADDEADYFCSSRDGSGNFLFGGGTKLTVL

SEQ ID NO: 625 - DNA, 321 bp, ARTIFICIAL
  Antibody
cagagcgtcttgactcaggaccctactgtgtctgtggccttggggcagacagtcaggatcacatgccgaggagacagactcagaagttattattcaagttggtaccagcagaagccacgacaggcccctgttcttgtcatgtttggtagaaacaaccggccctcagggatcccagaccgattctctggctccacctcaggaagcacagcttccttgaccatcactgcgactcaggcggacgatgaggctgactatttctgtagttcccgggacggcagtggtaatttcctcttcggcggagggaccaaactgaccgtcctt

SEQ ID NO: 626 - protein, 118 aa, ARTIFICIAL
  Antibody
EVQLLESGGGLVQPGGSLRLSCAASGFTFSIYPMHWVRQAPGKGLEWVSSIYPSGGITRYADSVKGRFTISRDNSKNTLYLQMNSLRAEDTALYYCARQRGSGWHDSWGQGTLVTVSS

SEQ ID NO: 627 - DNA, 354 bp, ARTIFICIAL
  Antibody
gaagttcaattgttagagtctggtggcggtcttgttcagcctggtggttctttacgtctttcttgcgctgcttccggattcactttctctatttaccctatgcattgggttcgccaagctcctggtaaaggtttggagtgggtttcttctatctatccttctggtggcattactcgttatgctgactccgttaaaggtcgcttcactatctctagagacaactctaagaatactctctacttgcagatgaacagcttaagggctgaggacaccgccttgtattactgtgcgagacaacggggcagtggctggcatgactcctggggccagggaaccctggtcaccgtctcaagc

SEQ ID NO: 628 - protein, 108 aa, ARTIFICIAL
  Antibody
QDIQMTQSPATLSLSPGERATLSCRASQSVSSYLAWYQQKPGQAPRLLIYDASNRATGIPARFSGSGSGTDFTLTISSLEPEDFAVYYCQQRSNWPVTFGQGTRLEIK

SEQ ID NO: 629 - DNA, 324 bp, ARTIFICIAL
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccggtcaccttcggccaagggacacgactggagattaaa

SEQ ID NO: 630 - protein, 118 aa, ARTIFICIAL
  Antibody
EVQLLESGGGLVQPGGSLRLSCAASGFTFSYYPMVWVRQAPGKGLEWVSVIVPSGGFTAYADSVKGRFTISRDNSKNTLYLQMNSLRAEDTAMYYCARKRPGNAFDIWGQGTMVTVSS

SEQ ID NO: 631 - DNA, 354 bp, ARTIFICIAL
  Antibody
gaagttcaattgttagagtctggtggcggtcttgttcagcctggtggttctttacgtctttcttgcgctgcttccggattcactttctcttattaccctatggtttgggttcgccaagctcctggtaaaggtttggagtgggtttctgttatcgttccttctggtggctttactgcttatgctgactccgttaaaggtcgcttcactatctctagagacaactctaagaatactctctacttgcagatgaacagcttaagggctgaggacaccgccatgtattactgtgcgagaaagcgacctggaaatgcttttgatatctggggccaagggacaatggtcaccgtctcaagc

SEQ ID NO: 632 - protein, 107 aa, ARTIFICIAL
  Antibody
QDIQMTQSPSFLSASVGDSVAITCRASQDISRFLAWYQQRPGKAPKLLIFSASTLQSGVPSRFSGSGSGTEFTLTINALQPEDFATYYCQQLSRYSTFGQGTKLEIK

SEQ ID NO: 633 - DNA, 321 bp, ARTIFICIAL
  Antibody
caagacatccagatgacccagtctccatccttcctgtctgcatctgtaggagacagtgtcgccatcacttgccgggccagtcaggacattagtcgttttttagcctggtatcagcaaagaccagggaaagcccctaaactcctgattttttctgcttccactttacaaagtggggtcccatccaggttcagcggcagtggatctgggacagaatttactctcacaatcaacgccctgcagcctgaagattttgcaacttattactgtcaacaacttagtcgttattcgacgttcggccaaggcaccaaactggaaatcaaa

SEQ ID NO: 634 - protein, 117 aa, ARTIFICIAL
  Antibody
EVQLLESGGGLVQPGGSLRLSCAASGFTFSYYKMWWVRQAPGKGLEWVSSISPGGWTHYADSVKGRFTISRDNSKNTLYLQMNSLRAEDTAVYYCARGPVSSGGDYWGQGTLVTVSS

SEQ ID NO: 635 - DNA, 351 bp, ARTIFICIAL
  Antibody
gaagttcaattgttagagtctggtggcggtcttgttcagcctggtggttctttacgtctttcttgcgctgcttccggattcactttctcttattacaagatgtggtgggttcgccaagctcctggtaaaggtttggagtgggtttcttctatctctcctggtggctggactcattatgctgactccgttaaaggtcgcttcactatctctagagacaactctaagaatactctctacttgcagatgaacagcttaagggctgaggacacggccgtgtattactgtgctagaggccctgtcagtagtggtggggactactggggccagggaaccctggtcaccgtctcaagc

SEQ ID NO: 636 - protein, 109 aa, ARTIFICIAL
  Antibody
QDIQMTQSPATLSLSPGERATLSCRASQSVSSYLAWYQQKPGQAPRLLIYDASNRATGIPARFSGSGSGTDFTLTISSLEPEDFAVYYCQQRSNWPPLTFGGGTKVEIK

SEQ ID NO: 637 - DNA, 327 bp, ARTIFICIAL
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgctcactttcggcggagggaccaaggtggagatcaaa

SEQ ID NO: 638 - protein, 119 aa, ARTIFICIAL
  Antibody
EVQLLESGGGLVQPGGSLRLSCAASGFTFSQYVMMWVRQAPGKGLEWVSSIYPSGGQTYYADSVKGRFTISRDNSKNTLYLQMNSLRAEDTAVYYCAKIAGGAYHLDYWGQGTLVTVSS

SEQ ID NO: 639 - DNA, 357 bp, ARTIFICIAL
  Antibody
gaagttcaattgttagagtctggtggcggtcttgttcagcctggtggttctttacgtctttcttgcgctgcttccggattcactttctctcagtacgttatgatgtgggttcgccaagctcctggtaaaggtttggagtgggtttcttctatctatccttctggtggccagacttattatgctgactccgttaaaggtcgcttcactatctctagagacaactctaagaatactctctacttgcagatgaacagcttaagggctgaggacacggccgtgtattactgtgcgaaaattgcagggggagcctaccaccttgattactggggccagggaaccctggtcaccgtctcaagc

SEQ ID NO: 640 - protein, 110 aa, ARTIFICIAL
  Antibody
QYELTQPASVSGSPGQSITISCTGTSSDVGGYNYVSWYQQHPGKAPKLTIFDVTKRPSGVSDRFSGSKSDNTASLTISGLQAEDEADYYCGSYTSSGSRVFGTGTKVTVL

SEQ ID NO: 641 - DNA, 330 bp, ARTIFICIAL
  Antibody
cagtacgaattgactcagcctgcctccgtgtctgggtctcctggacagtcgatcaccatctcctgcactggaaccagcagtgacgttggtggttataactatgtctcctggtaccaacaacacccaggcaaagcccccaaactcacgatttttgatgtcactaaacggccctcaggggtttctgatcgcttctctggctccaagtctgacaatacggcctccctgaccatctctgggctccaggctgaagacgaagctgattattactgcggctcatatacaagcagcggctctcgggtcttcggaactgggaccaaggtcaccgtcctc

SEQ ID NO: 642 - protein, 117 aa, ARTIFICIAL
  Antibody
EVQLLESGGGLVQPGGSLRLSCAASGFTFSRYVMGWVRQAPGKGLEWVSRIYPSGGFTYYADSVKGRFTISRDNSKNTLYLQMNSLRAEDTAVYYCTRIREGYFDYWGQGTLVTVSS

SEQ ID NO: 643 - DNA, 351 bp, ARTIFICIAL
  Antibody
gaagttcaattgttagagtctggtggcggtcttgttcagcctggtggttctttacgtctttcttgcgctgcttccggattcactttctctcgttacgttatgggttgggttcgccaagctcctggtaaaggtttggagtgggtttctcgtatctatccttctggtggctttacttattatgctgactccgttaaaggtcgcttcactatctctagagacaactctaagaatactctctacttgcagatgaacagcttaagggctgaggacacggccgtgtattactgtacgaggataagggaagggtactttgactactggggccagggaaccctggtcaccgtctcaagc

SEQ ID NO: 644 - protein, 109 aa, ARTIFICIAL
  Antibody
QDIQMTQSPSSLSASVGDRVAITCRASQSIDTYLNWYQQKPGKAPKLLIYAASKLEDGVPSRFSGSGTGTDFTLTIRSLQPEDFASYFCQQSYSSPGITFGPGTKVEIK

SEQ ID NO: 645 - DNA, 327 bp, ARTIFICIAL
  Antibody
caagacatccagatgacccagtctccatcctccctgtctgcatctgtgggagacagagtcgccatcacttgccgcgcaagtcagagcatcgacacctatttaaattggtatcagcagaaaccagggaaagcccctaaactcctgatctatgctgcatccaagttggaagacggggtcccatcaagattcagtggcagtggaactgggacagatttcactctcaccatcagaagtctgcaacctgaagattttgcaagttatttctgtcaacagagctactctagtccagggatcactttcggccctgggaccaaggtggagatcaaa

SEQ ID NO: 646 - protein, 125 aa, ARTIFICIAL
  Antibody
EVQLLESGGGLVQPGGSLRLSCAASGFTFSHYVMTWVRQAPGKGLEWVSSIYPSGGFTAYADSVTGRFTISRDNSKNTLYLQMNSLRAEDTAMYYCAKSTYYYEGSGYYRAFDIWGQGTMVTVSS

SEQ ID NO: 647 - DNA, 375 bp, ARTIFICIAL
  Antibody
gaagttcaattgttagagtctggtggcggtcttgttcagcctggtggttctttacgtctttcttgcgctgcttccggattcactttctctcattacgttatgacttgggttcgccaagctcctggtaaaggtttggagtgggtttcttctatctatccttctggtggctttactgcttatgctgactccgttacaggtcgcttcactatctctagagacaactctaagaatactctctacttgcagatgaacagcttaagggctgaggacaccgccatgtattactgtgcgaaatcgacttattactatgagggtagtggttattaccgcgcttttgatatctggggccaagggacaatggtcaccgtctcaagc

SEQ ID NO: 648 - protein, 109 aa, ARTIFICIAL
  Antibody
QDIQMTQSPATLSLSPGERATLSCRASQSVSSSYLAWYQQKPGQAPRLLIYGASNRATGIPARFSGSGSGTDFTLTISGLEPEDFVVYYCQKYGSSSLTFGGGTKVEIK

SEQ ID NO: 649 - DNA, 327 bp, ARTIFICIAL
  Antibody
caagacatccagatgacccagtctccagccaccctgtctctatctccaggggaaagagccaccctctcctgcagggccagtcagagtgttagcagcagctacttagcctggtaccagcagaaacctggccaggctcccaggctcctcatctatggtgcatccaacagggccactggcatcccagccaggttcagtggcagtgggtctgggacagacttcactctcaccatcagtggcctggagcctgaagattttgtagtgtattactgtcagaagtatggtagttcatcgctcactttcggcggagggaccaaggtggagatcaaa

SEQ ID NO: 650 - protein, 119 aa, ARTIFICIAL
  Antibody
EVQLLESGGGLVQPGGSLRLSCAASGFTFSQYKMWWVRQAPGKGLEWVSVIYPSGGVTYYADSVKGRFTISRDNSKNTLYLQMNSLRAEDTAVYYCAISYSPVGAFDIWGQGTMVTVSS

SEQ ID NO: 651 - DNA, 357 bp, ARTIFICIAL
  Antibody
gaagttcaattgttagagtctggtggcggtcttgttcagcctggtggttctttacgtctttcttgcgctgcttccggattcactttctctcagtacaagatgtggtgggttcgccaagctcctggtaaaggtttggagtgggtttctgttatctatccttctggtggcgttacttattatgctgactccgttaaaggtcgcttcactatctctagagacaactctaagaatactctctacttgcagatgaacagcttaagggctgaggacacggccgtgtattactgtgcgatctcgtatagtcccgtgggggcttttgatatctggggccaagggacaatggtcaccgtctcaagc

SEQ ID NO: 652 - protein, 110 aa, ARTIFICIAL
  Antibody
QSALTQPPSVSGSPGQSVTISCTGTSSDVGSYNRVSWYRQPPGTAPKVIIYDINNRPSGVPDRFSGSRSGDTAYLTISGLQVEDEADYYCSSFTSSSTYIFGTGTKVTVL

SEQ ID NO: 653 - DNA, 330 bp, ARTIFICIAL
  Antibody
cagagcgctttgactcagcctccctccgtgtccgggtctcctggacagtcagtcaccatttcctgcactggaaccagcagtgacgttggtagttataaccgtgtctcctggtaccggcagcccccaggcacagcccccaaagtcatcatttatgacatcaataatcggccctcaggtgtccctgatcgcttctctgggtccaggtctggcgacacggcctacctgaccatctctgggctccaggtggaggacgaggctgattattactgtagctcatttacaagcagcagcacctatatcttcggaactgggaccaaggtcaccgtcctg

SEQ ID NO: 654 - protein, 118 aa, ARTIFICIAL
  Antibody
EVQLLESGGGLVQPGGSLRLSCAASGFTFSVYKMYWVRQAPGKGLEWVSVIYPSGGYTDYADSVKGRFTISRDNSKNTLYLQMNSLRAEDTAVYYCARQLPMSYFDYWGQGTLVTVSS

SEQ ID NO: 655 - DNA, 354 bp, ARTIFICIAL
  Antibody
gaagttcaattgttagagtctggtggcggtcttgttcagcctggtggttctttacgtctttcttgcgctgcttccggattcactttctctgtttacaagatgtattgggttcgccaagctcctggtaaaggtttggagtgggtttctgttatctatccttctggtggctatactgattatgctgactccgttaaaggtcgcttcactatctctagagacaactctaagaatactctctacttgcagatgaacagcttaagggctgaggacacggccgtgtattactgtgcgcggcagctgcccatgtcgtactttgactactggggccagggaaccctggtcaccgtctcaagc

SEQ ID NO: 656 - protein, 112 aa, ARTIFICIAL
  Antibody
QDIQMTQSPLSLPVTPGEPASMSCRSSQSLLQSNGYNYLDWYLQKPGQSPQLLIYLGSNRASGVPDRFSGSGSGTDFTLKISRVEAEDVGVYYCMQALQTWTFGQGTKVEIK

SEQ ID NO: 657 - DNA, 336 bp, ARTIFICIAL
  Antibody
caagacatccagatgacccagtctccactctccctgcccgtcacccctggagagccggcctccatgtcctgcaggtctagtcagagcctcctgcaaagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaacttggacgttcggccaagggaccaaggtggaaatcaaa

SEQ ID NO: 658 - protein, 117 aa, ARTIFICIAL
  Antibody
EVQLLESGGGLVQPGGSLRLSCAASGFTFSRYVMVWVRQAPGKGLEWVSRIYPSGGFTNYADSVKGRFTISRDNSKNTLYLQMNSLRAEDTAVYYCARDKTAHMDVWGKGTTVTVSS

SEQ ID NO: 659 - DNA, 351 bp, ARTIFICIAL
  Antibody
gaagttcaattgttagagtctggtggcggtcttgttcagcctggtggttctttacgtctttcttgcgctgcttccggattcactttctctcgttacgttatggtttgggttcgccaagctcctggtaaaggtttggagtgggtttcgcgtatctatccttctggtggctttactaattatgctgactccgttaaaggtcgcttcactatctctagagacaactctaagaatactctctacttgcagatgaacagcttaagggctgaggacacggccgtgtattactgtgcgagagataagacagcccacatggacgtctggggcaaagggaccacggtcaccgtctcaagc

SEQ ID NO: 660 - protein, 109 aa, ARTIFICIAL
  Antibody
QDIQMTQSPATLSLSPGERATLSCRASQSVSSYLAWYQQKPGQAPRLLIYDASNRATGIPARFSGSGSGTDFTLTISSLEPEDFAVYYCQQRSSWPPLTFGGGTKVEIK

SEQ ID NO: 661 - DNA, 327 bp, ARTIFICIAL
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcagctggcctccgctcactttcggcggagggaccaaggtggagatcaag

SEQ ID NO: 662 - protein, 119 aa, ARTIFICIAL
  Antibody
EVQLLESGGGLVQPGGSLRLSCAASGFTFSRYKMNWVRQAPGKGLEWVSSIYPSGGWTNYADSVKGRFTISRDNSKNTLYLQMNSLRAEDTAVYYCARGGRYGDYVRHWGQGTLVTVSS

SEQ ID NO: 663 - DNA, 357 bp, ARTIFICIAL
  Antibody
gaagttcaattgttagagtctggtggcggtcttgttcagcctggtggttctttacgtctttcttgcgctgcttccggattcactttctctcgttacaagatgaattgggttcgccaagctcctggtaaaggtttggagtgggtttcttctatctatccttctggtggctggactaattatgctgactccgttaaaggtcgcttcactatctctagagacaactctaagaatactctctacttgcagatgaacagcttaagggctgaggacacggccgtgtattactgtgccagaggggggagatacggtgactacgtgcgtcactggggccagggaaccctggtcaccgtctcaagc

SEQ ID NO: 664 - protein, 108 aa, ARTIFICIAL
  Antibody
QDIQMTQSPATLSVSPGERATLSCRASQSVSSNLAWYQHKPGQAPRLLIYGASIRATGIPARFSGSGSGTEFTLTISSLQSEDFGVYYCQQYKDWPRTFGQGTKVEIK

SEQ ID NO: 665 - DNA, 324 bp, ARTIFICIAL
  Antibody
caagacatccagatgacccagtctccagccaccctgtctgtgtctccaggggaaagagccactctctcctgcagggccagtcagagtgttagcagcaacttagcctggtaccagcacaaacctggccaggctcccaggctcctcatctatggtgcatccatcagggccactggtatcccagccaggttcagtggcagtgggtctgggacagagttcactctcaccatcagcagcctgcagtctgaagattttggagtttattattgtcagcagtataaggactggcctcgaacgttcggccaagggaccaaggtggaaatcaaa

SEQ ID NO: 666 - protein, 120 aa, ARTIFICIAL
  Antibody
EVQLLESGGGLVQPGGSLRLSCAASGFTFSRYRMAWVRQAPGKGLEWVSSIYPSGGVTYYADSVKGRFTISRDNSKNTLYLQMNSLRAEDTAVYYCARDLSIAAAGTAYWGQGTLVTVSS

SEQ ID NO: 667 - DNA, 360 bp, ARTIFICIAL
  Antibody
gaagttcaattgttagagtctggtggcggtcttgttcagcctggtggttctttacgtctttcttgcgctgcttccggattcactttctctcgttaccgtatggcttgggttcgccaagctcctggtaaaggtttggagtgggtttcttctatctatccttctggtggcgttacttattatgctgactccgttaaaggtcgcttcactatctctagagacaactctaagaatactctctacttgcagatgaacagcttaagggctgaggacacggccgtgtattactgtgcaagagatcttagtatagcagcagctggtactgcctactggggccagggaaccctggtcaccgtctcaagc

SEQ ID NO: 668 - protein, 110 aa, ARTIFICIAL
  Antibody
QDIQMTQSPGTLSLSPGERATLSCRASQSFVGSRNLAWYQQKPGQPPRLLIYGAFNRATGIPGRFSGSGSGTDFTLTISRLEPEDFAVYYCQQYGTSPRTFGGGTKVEIK

SEQ ID NO: 669 - DNA, 330 bp, ARTIFICIAL
  Antibody
caagacatccagatgacccagtctccaggcacgctgtctttgtctccaggggaaagagccaccctctcctgcagggccagtcagagttttgtcggcagcagaaacttagcctggtaccagcaaaaacctggccagcctcccaggctcctcatctatggtgcattcaacagggccactggcatcccaggcaggtttagtggcagtggctctgggacagacttcactctcaccatcagcagactggagcctgaagattttgcagtgtattactgtcagcagtatggtacgtcacctcggactttcggcggagggaccaaagtggagatcaaa

SEQ ID NO: 670 - protein, 118 aa, ARTIFICIAL
  Antibody
EVQLLESGGGLVQPGGSLRLSCAASGFTFSRYVMQWVRQAPGKGLEWFSSIYPSGGATIYADSVKGRFTISRDNSKNTLYLQMNSLRAEDTAVYYCARRGIPGYFDSWGQGTLVTVSS

SEQ ID NO: 671 - DNA, 354 bp, ARTIFICIAL
  Antibody
gaagttcaattgttagagtctggtggcggtcttgttcagcctggtggttctttacgtctttcttgcgctgcttccggattcactttctctcgttacgttatgcagtgggttcgccaagctcctggtaaaggtttggagtggttttcttctatctatccttctggtggcgctactatttatgctgactccgttaaaggtcgcttcactatctctagagacaactctaagaatactctctacttgcagatgaacagcttaagggctgaggacacggccgtgtattactgtgcgagaaggggaattccgggctactttgactcctggggccagggaaccctggtcaccgtctcaagc

SEQ ID NO: 672 - protein, 110 aa, ARTIFICIAL
  Antibody
QDIQMTQSPLSLSASIGDRVTITCRASQSISTYLNWYQQKPGKAPKLLIYATSTLQSGVPSRFSGSGSGTEFILTISGLQPEDFATYYCQQFNFYPLTLGGGTRVEIKRT

SEQ ID NO: 673 - DNA, 330 bp, ARTIFICIAL
  Antibody
caagacatccagatgacccagtctccactctccctgtctgcatctataggagacagagtcaccatcacttgccgggcaagtcagagcattagcacctatttaaattggtatcagcagaagccagggaaagcccctaaactcctgatctatgcaacttccactttacagagtggggtcccatcaaggttcagcggcagtggatctgggacagaattcattctcacaatcagcggcctgcagcctgaagattttgcaacttattactgtcaacagtttaatttttatcctctcactctcggcggagggaccagggtggagatcaaacgaact

SEQ ID NO: 674 - protein, 116 aa, ARTIFICIAL
  Antibody
EVQLLESGGGLVQPGGSLRLSCAASGFTFSSYGMVWVRQAPGKGLEWVSSISPSGGNTGYADSVKGRFTISRDNSKNTLYLQMNSLRAEDTAVYYCARGNGGFDSWGQGTLVTVSS

SEQ ID NO: 675 - DNA, 348 bp, ARTIFICIAL
  Antibody
gaagttcaattgttagagtctggtggcggtcttgttcagcctggtggttctttacgtctttcttgcgctgcttccggattcactttctcttcttacggtatggtttgggttcgccaagctcctggtaaaggtttggagtgggtttcttctatctctccttctggtggcaatactggttatgctgactccgttaaaggtcgcttcactatctctagagacaactctaagaatactctctacttgcagatgaacagcttaagggctgaggacacggccgtgtattactgtgcaagaggaaatggtggctttgactcctggggccagggaaccctggtcaccgtctcaagc

SEQ ID NO: 676 - protein, 110 aa, ARTIFICIAL
  Antibody
QSVLTQPASVSGSPGQSITISCTGTSSDVGSYNLVSWYQQHPGKAPKLMIYEGSKRPSGVSNRFSGSKSGNTASLTISGLQAEDEADYYCCSYAGSSTYVFGTGTKVTVL

SEQ ID NO: 677 - DNA, 330 bp, ARTIFICIAL
  Antibody
cagagcgtcttgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcacttatgtcttcggaactgggaccaaggtcaccgtccta

SEQ ID NO: 678 - protein, 118 aa, ARTIFICIAL
  Antibody
EVQLLESGGGLVQPGGSLRLSCAASGFTFSHYVMSWVRQAPGKGLEWVSVIYPSGGWTGYADSVKGRFTISRDNSKNTLYLQMNSLRAEDTAVYYCARGVATTSFDYWGQGTLVTVSS

SEQ ID NO: 679 - DNA, 354 bp, ARTIFICIAL
  Antibody
gaagttcaattgttagagtctggtggcggtcttgttcagcctggtggttctttacgtctttcttgcgctgcttccggattcactttctctcattacgttatgtcttgggttcgccaagctcctggtaaaggtttggagtgggtttctgttatctatccttctggtggctggactggttatgctgactccgttaaaggtcgcttcactatctctagagacaactctaagaatactctctacttgcagatgaacagcttaagggctgaggacacggccgtgtattactgtgcgagaggggtggcaactactagttttgactactggggccagggaaccctggtcaccgtctcaagc

SEQ ID NO: 680 - protein, 110 aa, ARTIFICIAL
  Antibody
QDIQMTQSPATLSLSPGERATLSCRASQSVSSYLAWYQQKPGQAPRLLIYDASNRATGIPARFSGSGSGTDFTLTISSLEPEDFAVYYCQQRSNWPRSITFGQGTRLEIK

SEQ ID NO: 681 - DNA, 330 bp, ARTIFICIAL
  Antibody
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcgatcgatcaccttcggccaagggacacgactggagattaaa

SEQ ID NO: 682 - protein, 121 aa, ARTIFICIAL
  Antibody
EVQLLESGGGLVQPGGSLRLSCAASGFTFSRYLMRWVRQAPGKGLEWVSGIYPSGGITAYADSVKGRFTISRDNSKNTLYLQMNSLRAEDTAVYYCARASGSYYNYYFDYWGQGTLVTVSS

SEQ ID NO: 683 - DNA, 363 bp, ARTIFICIAL
  Antibody
gaagttcaattgttagagtctggtggcggtcttgttcagcctggtggttctttacgtctttcttgcgctgcttccggattcactttctctcgttaccttatgcgttgggttcgccaagctcctggtaaaggtttggagtgggtttctggtatctatccttctggtggcattactgcttatgctgactccgttaaaggtcgcttcactatctctagagacaactctaagaatactctctacttgcagatgaacagcttaagggctgaggacacggccgtgtattactgtgcgagagcttcggggagttattataattactactttgactactggggccagggcaccctggtcaccgtctcaagc

SEQ ID NO: 684 - protein, 109 aa, ARTIFICIAL; identical to SEQ ID NO: 588
  Antibody

SEQ ID NO: 685 - DNA, 327 bp, ARTIFICIAL; identical to SEQ ID NO: 589
  Antibody

SEQ ID NO: 686 - protein, 117 aa, ARTIFICIAL
  Antibody
EVQLLESGGGLVQPGGSLRLSCAASGFTFSAYVMHWVRQAPGKGLEWVSRIYPSGGITYYADSVKGRFTISRDNSKNTLYLQMNSLRAEDTAVYYCARGILTGPNYWGQGTLVTVSS

SEQ ID NO: 687 - DNA, 351 bp, ARTIFICIAL
  Antibody
gaagttcaattgttagagtctggtggcggtcttgttcagcctggtggttctttacgtctttcttgcgctgcttccggattcactttctctgcttacgttatgcattgggttcgccaagctcctggtaaaggtttggagtgggtttctcgtatctatccttctggtggcattacttattatgctgactccgttaaaggtcgcttcactatctctagagacaactctaagaatactctctacttgcagatgaacagcttaagggctgaggacacggccgtgtattactgtgcgagagggattttgactggcccaaactactggggccagggaaccctggtcaccgtctcaagc

SEQ ID NO: 688 - protein, 111 aa, ARTIFICIAL
  Antibody
QSALTQSPSASASLGASVKLTCSLSSGHSSYAIAWHQQQPEKGPQYLMKVNSDGSHTKGDGIPDRFSGSSSGAERYLTISSLQSEDEADYYCQTWGTGSWVFGGGTKLTVL

SEQ ID NO: 689 - DNA, 333 bp, ARTIFICIAL
  Antibody
cagagcgctttgactcaatcgccctctgcctctgcctccctgggagcctcggtcaagctcacctgcagtctgagcagtgggcacagcagctacgccatcgcatggcatcagcagcagccagagaagggcccccagtacttaatgaaggttaacagtgatggcagccacaccaagggggacgggatccctgatcgcttctcaggctccagctctggggctgagcgctacctcaccatctccagcctccagtctgaggatgaggctgactattactgtcagacctggggcactggctcttgggtgttcggcggagggaccaagctgaccgtccta

SEQ ID NO: 690 - protein, 117 aa, ARTIFICIAL
  Antibody
EVQLLESGGGLVQPGGSLRLSCAASGFTFSRYKMSWVRQAPGKGLEWVSYIYPSGGHTEYADSVKGRFTISRDNSKNTLYLQMNSLRAEDTAVYYCAREREGTPDYWGQGTLVTVSS

SEQ ID NO: 691 - DNA, 351 bp, ARTIFICIAL
  Antibody
gaagttcaattgttagagtctggtggcggtcttgttcagcctggtggttctttacgtctttcttgcgctgcttccggattcactttctctcgttacaagatgtcttgggttcgccaagctcctggtaaaggtttggagtgggtttcttatatctatccttctggtggccatactgagtatgctgactccgttaaaggtcgcttcactatctctagagacaactctaagaatactctctacttgcagatgaacagcttaagggctgaggacacggccgtgtattactgtgcgagagaaagggaagggacccctgactactggggccagggaaccctggtcaccgtctcaagc

SEQ ID NO: 692 - protein, 111 aa, ARTIFICIAL
  Antibody
QSVLTQPASVSGSPGQSITISCTGTSSDDVGGYNYVSWYQQHPGKAPKLLIYDVINRPSGVSNRFSGSKSGNTASLTISGLQAEDEADYYCSSYASSGARVFGTGTKVTVL

SEQ ID NO: 693 - DNA, 333 bp, ARTIFICIAL
  Antibody
cagagcgtcttgactcagcctgcctccgtgtctgggtctcctggacagtcgatcaccatctcctgcactggaaccagcagtgacgacgttggtggttataactatgtctcctggtaccaacaacacccaggcaaagcccccaaactcctgatttatgatgtcattaatcggccctcaggagtttctaatcgcttctctgggtccaagtctggcaacacggcctccctgaccatctctgggctccaggctgaggacgaggctgattattactgcagctcatatgcaagcagcggcgctcgagtcttcggaactgggaccaaggtcaccgtccta

SEQ ID NO: 694 - protein, 121 aa, ARTIFICIAL
  Antibody
EVQLLESGGGLVQPGGSLRLSCAASGFTFSIYPMIWVRQAPGKGLEWVSVIYPSGGHTRYADSVKGRFTISRDNSKNTLYLQMNSLRAEDTAVYYCTRRVYSSGSAYFDLWGRGTLVTVSS

SEQ ID NO: 695 - DNA, 363 bp, ARTIFICIAL
  Antibody
gaagttcaattgttagagtctggtggcggtcttgttcagcctggtggttctttacgtctttcttgcgctgcttccggattcactttctctatttaccctatgatttgggttcgccaagctcctggtaaaggtttggagtgggtttctgttatctatccttctggtggccatactcgttatgctgactccgttaaaggtcgcttcactatctctagagacaactctaagaatactctctacttgcagatgaacagcttaagggctgaggacacagccgtgtattactgtacgagacgggtatatagtagtggttctgcgtacttcgatctctggggccgtggcaccctggtcaccgtctcaagc

SEQ ID NO: 696 - protein, 108 aa, ARTIFICIAL
  Antibody
QDIQMTQSPSTLSASVGDRVTITCRASQSVAGLLAWFQQKPGKAPKLLISKASILETGVPSRFSGSGSGTEFTLTITSLQPDDFATYYCQQYSFNSGTFGQGTRVEMK

SEQ ID NO: 697 - DNA, 324 bp, ARTIFICIAL
  Antibody
caagacatccagatgacccagtctccttccaccctgtctgcatctgtgggagacagagtcaccatcacctgccgggccagccagagtgttgctggcttgttggcctggtttcagcagaaaccgggcaaagcccctaaactcctcatctctaaggcgtctattttagagactggggtcccatcaaggttcagcggcagtggatctgggacagaattcactctcaccatcaccagcctgcagcctgatgatttcgcaacttattactgccaacaatatagtttcaattctgggacattcggccaagggaccagggtggaaatgaaa

SEQ ID NO: 698 - protein, 117 aa, ARTIFICIAL
  Antibody
EVQLLESGGGLVQPGGSLRLSCAASGFTFSMYKMAWVRQAPGKGLEWVSYIYPSGGYTYYADSVKGRFTISRDNSKNTLYLQMNSLRAEDTALYYCARVRDSAFDIWGQGTMVTVSS

SEQ ID NO: 699 - DNA, 351 bp, ARTIFICIAL
  Antibody
gaagttcaattgttagagtctggtggcggtcttgttcagcctggtggttctttacgtctttcttgcgctgcttccggattcactttctctatgtacaagatggcttgggttcgccaagctcctggtaaaggtttggagtgggtttcttatatctatccttctggtggctatacttattatgctgactccgttaaaggtcgcttcactatctctagagacaactctaagaatactctctacttgcagatgaacagcttaagggctgaggacaccgccttgtattactgtgcgagagtaagggattccgcttttgatatctggggccaagggacaatggtcaccgtctcaagc

SEQ ID NO: 700 - protein, 214 aa, Artificial Sequence
  Antibody
DIQMTQSPSSLSASVGDRVTITCRASQGIGHYLAWYQQKPGKVPKLLIYTASTLQSGVPSRFSGSGSGTDFTLTISSLQPEDVATYYCQQFNSYPHTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 701 - protein, 450 aa, Artificial Sequence
  Antibody
EVQLLESGGGLVQPGGSLRLSCAASGFTFSMYGMVWVRQAPGKGLEWVSVISPSGGNTGYADSVKGRFTISRDNSKNTLYLQMNSLRAEDTAVYYCARAPRGYSYGYYYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 702 - DNA, 660 bp, Artificial Sequence
  Antibody
ggcgtgcactctgacatccagatgacccagtctccatcctccctgtctgcatctgtaggagacagagtcaccatcacttgccgggcgagtcagggcattggccattatttagcctggtatcagcagaaaccagggaaagttcctaagctcctgatctatactgcatccactttgcaatcaggggtcccatctcggttcagtggcagtggatctgggacagatttcactctcaccatcagcagcctgcagcctgaagatgttgcaacttattactgtcaacagtttaatagttaccctcacaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaataa

SEQ ID NO: 703 - DNA, 1353 bp, Artificial Sequence
  Antibody
gaagttcaattgttagagtctggtggcggtcttgttcagcctggtggttctttacgtctttcttgcgctgcttccggattcactttctctatgtacggtatggtttgggttcgccaagctcctggtaaaggtttggagtgggtttctgttatctctccttctggtggcaatactggttatgctgactccgttaaaggtcgcttcactatctctagagacaactctaagaatactctctacttgcagatgaacagcttaagggctgaggacactgcagtctactattgtgcgagagccccacgtggatacagctatggttactactactggggccagggaaccctggtcaccgtctcaagcgcctccaccaagggcccatcggtcttcccgctagcaccctcctccaagagcacctctgggggcacagcggccctgggctgcctggtcaaggactacttccccgaaccggtgacggtgtcgtggaactcaggcgccctgaccagcggcgtccacaccttcccggctgtcctacagtcctccggactctactccctcagcagcgtagtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 704 - protein, 13 aa, Artificial Sequence
  Synthetically generated peptide
  VARIANT 1: Xaa = any amino acid
  VARIANT 8: Xaa = Trp, Pro or Ser
  VARIANT 10: Xaa = Tyr, Val or His
XIYPSGGXTXYAD

SEQ ID NO: 705 - protein, 8 aa, Artificial Sequence
  Synthetically generated peptide
  VARIANT 2, 3: Xaa = any amino acid
  VARIANT 5: Xaa = Ala, Tyr
  VARIANT 8: Xaa = Tyr, Ile
GXXGXFDX

SEQ ID NO: 706 - protein, 11 aa, Artificial Sequence
  Synthetically generated peptide
  VARIANT 6: Xaa = Ile, Val
  VARIANT 9: Xaa = Tyr, Ser
  VARIANT 11: Xaa = Ala, Leu, Asn
RASQSXSSXLX

SEQ ID NO: 707 - protein, 10 aa, Artificial Sequence
  Synthetically generated peptide
  VARIANT 4: Xaa = Ser, Asn
  VARIANT 9: Xaa = Gly, Ser
TGTXSDVGXY

SEQ ID NO: 708 - protein, 10 aa, Artificial Sequence
  Synthetically generated peptide
  VARIANT 1: Xaa = Ser, Gly, Gln
  VARIANT 2: Xaa = Gly, Ser
  VARIANT 3: Xaa = Asp, Ser
  VARIANT 4: Xaa = Asn, Ser
  VARIANT 5: Xaa = Ile, Leu
  VARIANT 6: Xaa = Gly, Arg
  VARIANT 8: Xaa = Tyr, Lys, Asn
  VARIANT 9: Xaa =  Tyr, Ser
  VARIANT 10: Xaa = Val, Ala
XXXXXXSXXX

SEQ ID NO: 709 - protein, 7 aa, Artificial Sequence
  Synthetically generated peptide
  VARIANT 1: Xaa = Asp, Gly
  VARIANT 2: Xaa = Ala, Val
  VARIANT 5: Xaa = Arg, Leu
  VARIANT 6: Xaa = Ala, Pro
  VARIANT 7: Xaa = Ser, Thr
XXSNXXX

SEQ ID NO: 710 - protein, 10 aa, Artificial Sequence
  Synthetically generated peptide
  VARIANT 3: Xaa = any amino acid
  VARIANT 5: Xaa = Ser, Asn
  VARIANT 6: Xaa = Trp, Ser What about position 8?
QQXSXXPXTF

SEQ ID NO: 711 - protein, 8 aa, Artificial Sequence
  Synthetically generated peptide
  VARIANT 2: Xaa = Thr, Gly
  VARIANT 3: Xaa = Ser, Gly
  VARIANT 5: Xaa = Pro, Gly, Ser
  VARIANT 6: Xaa = Thr, Asn
  VARIANT 7: Xaa = any amino acid
  VARIANT 8: Xaa = Val, Thr
YXXSXXXX

SEQ ID NO: 712 - protein, 11 aa, Artificial Sequence
  Synthetically generated peptide
APRGYSYGYYY

SEQ ID NO: 713 - protein, 7 aa, Artificial Sequence
  Synthetically generated peptide
  VARIANT 1: Xaa = Thr, Ala, Gly, Asp
  VARIANT 4: Xaa = Ser, Thr, Asn
  VARIANT 5: Xaa = Leu, Arg
  VARIANT 6: Xaa = Ala, Glu, Gln
  VARIANT 7: Xaa = Ser, Thr
XASXXXX

SEQ ID NO: 714 - protein, 9 aa, Artificial Sequence
  Synthetically generated peptide
  VARIANT 3: Xaa =Ser, Tyr, Phe, Arg
  VARIANT 4: Xaa = Gly, Ser, Tyr, Asn
  VARIANT 6: Xaa = Ser, Thr, Tyr, Trp
  VARIANT 7: Xaa = Arg, Pro
  VARIANT 8: Xaa = Leu, His, Trp, Arg
  VARIANT 9: Xaa = Thr, Ile, Tyr
QQXXSXXXX

SEQ ID NO: 715 - protein, 9 aa, Artificial Sequence
  Synthetically generated peptide
  VARIANT 1: Xaa = Leu, Gln
  VARIANT 3: Xaa = Ser, Tyr, Phe, Arg
  VARIANT 4: Xaa = Gly, Ser, Tyr, Asn
  VARIANT 5: Xaa = Ser, Lys, Asn
  VARIANT 6: Xaa = Ser, Thr, Tyr, Trp
  VARIANT 7: Xaa = Arg, Pro
  VARIANT 8: Xaa = Leu, His, Trp, Arg
  VARIANT 9: Xaa = Thr, Ile, Tyr
XQXXXXXXX

SEQ ID NO: 716 - protein, 9 aa, Artificial Sequence
  Synthetically generated peptide
  VARIANT 1, 2: Xaa = Leu, Gln
  VARIANT 3: Xaa = Ser, Tyr, Phe, Arg, Asp
  VARIANT 4: Xaa = Gly, Ser, Tyr, Asn
  VARIANT 5: Xaa = Ser, Thr, Arg, Lys, Asn
  VARIANT 6: Xaa = Ser, Thr, tyr, Trp, Phe
  VARIANT 7: Xaa = Arg,  Pro
  VARIANT 8: Xaa = Ile, Leu, Met, Trp, Arg, His
  VARIANT 9: Xaa = Thr, Ile, Tyr
XXXXXXXXX

SEQ ID NO: 717 - DNA, 51 bp, Artificial Sequence
  Primer
ttcactatctctagagacaactctaagaatactctctacttgcagatgaac

SEQ ID NO: 718 - protein, 17 aa, Artificial Sequence
  Synthetically generated peptide
FTISRDNSKNTLYLQMN

SEQ ID NO: 719 - DNA, 23 bp, Artificial Sequence
  Primer
ggagggtgctagcgggaagaccg

SEQ ID NO: 720 - protein, 19 aa, Artificial Sequence
  Synthetically generated peptide
MGWSCIILFLVATATGVHS

SEQ ID NO: 721 - protein, 19 aa, Artificial Sequence
  Synthetically generated peptide
MGWSCIILFLVATATGAHS

SEQ ID NO: 722 - protein, 13 aa, Artificial Sequence
  Synthetically generated peptide
  VARIANT 1: Xaa = any amino acid
  VARIANT 8: Xaa = Trp, Pro or Ser
  VARIANT 10: xaa = Tyr, val or His
XIYPSGGXTXYAD

SEQ ID NO: 723 - protein, 450 aa, Artificial Sequence
  Synthetically generated peptide
EVQLLESGGGLVQPGGSLRLSCAASGFTFSMYGMVWVRQAPGKGLEWVSVISPSGGNTGYADSVKGRFTISRDNSKNTLYLQMNSLRAEDTAVYYCARAPRGYSYGYYYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 724 - protein, 214 aa, Artificial Sequence; identical to SEQ ID NO: 700
  Synthetically generated peptide

SEQ ID NO: 725 - DNA, 1419 bp, Artificial Sequence
  Synthetically generated oligonucleotide
atgggctggtcctgtatcatcctgtttctggtggccaccgccaccggcgctcactctgaggtgcagctgctggagtctggcggcggactggtgcagcctggcggctctctgagactgtcttgtgccgcctccggcttcaccttctccatgtacggcatggtgtgggtgaggcaggcccctggcaagggcctggagtgggtgtccgtgatctctccttctggcggcaataccggctacgccgactctgtgaagggccggttcaccatctcccgggacaactccaagaacaccctgtacctgcagatgaactccctgagagccgaggataccgccgtgtactactgtgccagagcccctagaggctactcctacggctactactactggggccagggcaccctggtgaccgtgtcctctgcttctaccaagggcccttccgtgtttcctctggccccttcctccaagtctacctctggcggcaccgccgctctgggctgcctggtgaaggactacttccctgagcccgtgacagtgtcctggaactctggcgccctgacctccggcgtgcacaccttccctgctgtgctgcagtcctccggcctgtactctctgtcctccgtggtgacagtgccttcctcttctctgggcacccagacctacatctgtaacgtgaaccacaagccctccaacaccaaggtggacaagcgggtggagcctaagtcctgtgacaagacccacacctgccctccttgtcctgcccctgagctgctgggcggaccttctgtgttcctgttcccccccaagcctaaggacaccctgatgatctccaggacccctgaggtgacctgtgtggtggtggacgtgtctcacgaggatcccgaggtgaagttcaactggtacgtggacggcgtggaggtgcacaacgccaagaccaagcctagggaggagcagtacaactccacctaccgggtggtgtctgtgctgaccgtgctgcaccaggattggctgaacggcaaggagtacaagtgtaaggtgtccaacaaggccctgcctgcccctatcgaaaagaccatctccaaggccaagggccagcctagagagcctcaggtgtacaccctgcctccttccagggaggagatgaccaagaaccaggtgtccctgacctgtctggtgaagggcttctacccttccgatatcgccgtggagtgggagtctaatggccagcccgagaacaactacaagaccacccctcctgtgctggactctgacggctccttcttcctgtactccaagctgaccgtggacaagtccagatggcagcagggcaacgtgttctcctgctccgtgatgcacgaggccctgcacaatcactacacccagaagtccctgtctctgtcccccggcaagtgatgagaattc

SEQ ID NO: 726 - DNA, 711 bp, Artificial Sequence
  Synthetically generated oligonucleotide
atgggctggtcctgtatcatcctgtttctggtggccaccgccaccggcgtgcactctgacatccagatgacccagtccccttcctctctgtctgcctctgtgggcgacagagtgaccatcacctgtagagcctctcagggcatcggccactacctggcctggtatcagcagaagcctggcaaggtgcccaagctgctgatctacaccgcctccaccctgcagtctggcgtgccttccagattctccggctctggctctggcaccgatttcaccctgaccatctcctccctgcagcctgaggatgtggccacctactactgccagcagttcaactcctacccccacaccttcggccagggcaccagactggagatcaagagaaccgtggccgctccttccgtgttcatcttccccccttccgacgagcagctgaagtctggcaccgcctctgtggtgtgtctgctgaacaacttctacccccgggaggccaaggtgcagtggaaggtggacaacgccctgcagtccggcaattcccaggagtctgtgaccgagcaggactccaaggacagcacctactccctgtcctctaccctgaccctgtccaaggccgactacgagaagcacaaggtgtacgcctgtgaggtgacccaccagggcctgtcctctcctgtgaccaagtccttcaaccggggcgagtgctgatgagaattc

What is claimed:

1. A method of inhibiting vascular development in a subject, the method comprising
administering, to a subject an isolated Tie1 binding protein, wherein the protein comprises a heavy chain (HC) immunoglobulin variable domain sequence and a light chain (LC) immunoglobulin variable domain sequence, wherein the protein binds to Tie1 ectodomain and
(A) the heavy chain immunoglobulin variable domain sequence comprises the following properties:
i) a HC CDR1 that includes (AGSIMRH)-Y-(GVMK)-M-(GSVMFH) (SEQ ID NO:118);
ii) a HC CDR2 that includes (GSV)-I-(SY)-P-S-G-G-(WNQ)-T-(GY) (SEQ ID NO:160); and
iii) a HC CDR3 that includes A-P-R-G-Y-S-Y-G-Y-Y-Y (SEQ ID NO:157); and
(B) the light chain immunoglobulin variable domain sequence comprises the following properties:
i) a LC CDR1 that includes R-A-S-(REQ)-(GSTRN)-(IV)-(GSTIRN)-(STIRH)-X1-(SYWNH)-(LV)-(ASN) (SEQ ID NO:132), wherein X1 can be serine or absent;
ii) a LC CDR2 that includes (AGTKDEH)-A-S-(STN)-(LR)-(AVEQ)-(ST) (SEQ ID NO:136); and
iii) a LC CDR3 that includes Q-Q-F-N-S-Y-P-H (SEQ ID NO:158).

2. The method of claim 1 wherein the agent is administered in an amount or a time effective to decrease vascular development in a subject.

3. The method of claim 1 wherein the subject has a vasculature-dependent cancer or tumor.

4. The method of claim 3 wherein the tumor is a solid tumor.

5. The method of claim 1 further comprising providing a second therapy that is an anti-cancer therapy.

6. The method of claim 5 wherein the second therapy is a chemotherapeutic.

7. The method of claim 5 wherein the second therapy comprises administering an agent that antagonizes signaling through a VEGF pathway.

8. The method of claim 5 wherein the second therapy comprises administering bevacizumab.

9. The method of claim 5 wherein the second therapy comprises administering 5-FU, leucovorin, or irinotecan.

10. The method of claim 1, wherein the protein inhibits tube formation by HUVEC cells in vitro.

11. The method of claim 1, wherein the protein is a Fab.

12. The method of claim 1, wherein the protein is an IgG.

13. The method of claim 1, wherein the amino acid sequences of the HC variable domain sequence comprise residues 31-35 of SEQ ID NO:114, residues 50-66 of SEQ ID NO:114, and residues 99-109 of SEQ ID NO:114, and the LC variable domain sequence comprises residues 24-34 of SEQ ID NO:116, residues 50-56 of SEQ ID NO:116, and residues 89-96 of SEQ ID NO:116.

14. The method of claim 1, wherein the protein comprises SEQ ID NO:114.

15. The method of claim 1, wherein the protein comprises SEQ ID NO:116.

16. The method of claim 1, wherein the protein comprises SEQ ID NOS: 114 and 116.

17. The method of claim 1, wherein the protein comprises residues 1-141 of SEQ ID NO:701.

18. The method of claim 1, wherein the protein comprises SEQ ID NO:159.

19. The method of claim 1, wherein the protein comprises residues 1-141 of SEQ ID NO:701 and SEQ ID NO:159.

20. The method of claim 1, wherein the protein comprises SEQ ID NO:701.

21. The method of claim 1, wherein the protein comprises SEQ ID NO:700.

22. The method of claim 1, wherein the subject has colon cancer.

23. The method of claim 1, wherein the subject has rectal cancer.

24. The method of claim 1, wherein the subject has renal cell cancer.

25. The method of claim 1, wherein the subject has liver cancer.

26. The method of claim 1, wherein the subject has lung cancer.

27. The method of claim 26, wherein the lung cancer is non-small cell lung cancer.

28. The method of claim 1, wherein the subject has breast cancer.

29. The method of claim 1, wherein the subject has prostate cancer.

30. The method of claim 1, wherein the subject has ovarian cancer.

* * * * *

UNITED STATES PATENT AND TRADEMARK OFFICE
CERTIFICATE OF CORRECTION

| | | |
|---|---|---|
| PATENT NO. | : 7,485,297 B2 | Page 1 of 1 |
| APPLICATION NO. | : 11/199739 | |
| DATED | : February 3, 2009 | |
| INVENTOR(S) | : Wood et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 337 days.

Signed and Sealed this
Seventh Day of August, 2012

David J. Kappos
*Director of the United States Patent and Trademark Office*